US011407837B2

(12) United States Patent
Glanville

(10) Patent No.: US 11,407,837 B2
(45) Date of Patent: Aug. 9, 2022

(54) GPCR BINDING PROTEINS AND SYNTHESIS THEREOF

(71) Applicant: Twist Bioscience Corporation, South San Francisco, CA (US)

(72) Inventor: Jacob Glanville, San Francisco, CA (US)

(73) Assignee: Twist Bioscience Corporation, South San Francisco, CA (US)

(*) Notice: Subject to any disclaimer, the term of this patent is extended or adjusted under 35 U.S.C. 154(b) by 0 days.

(21) Appl. No.: 16/128,372

(22) Filed: Sep. 11, 2018

(65) Prior Publication Data

US 2019/0135926 A1 May 9, 2019

Related U.S. Application Data

(60) Provisional application No. 62/556,863, filed on Sep. 11, 2017.

(51) Int. Cl.
*C07K 16/28* (2006.01)
*C07K 16/00* (2006.01)
*C12N 15/10* (2006.01)

(52) U.S. Cl.
CPC ........ *C07K 16/2869* (2013.01); *C07K 16/005* (2013.01); *C12N 15/1044* (2013.01); *C12N 15/1068* (2013.01); *C07K 2317/56* (2013.01); *C07K 2317/565* (2013.01)

(58) Field of Classification Search
CPC .......... C07K 2317/565; C07K 2317/56; C07K 16/2869; C12N 15/1044; C12N 15/1068
See application file for complete search history.

(56) References Cited

U.S. PATENT DOCUMENTS

| | | |
|---|---|---|
| 3,549,368 A | 12/1970 | Robert et al. |
| 3,920,714 A | 11/1975 | Streck |
| 4,123,661 A | 10/1978 | Wolf et al. |
| 4,415,732 A | 11/1983 | Caruthers et al. |
| 4,613,398 A | 9/1986 | Chiong et al. |
| 4,726,877 A | 2/1988 | Fryd et al. |
| 4,808,511 A | 2/1989 | Holmes |
| 4,837,401 A | 6/1989 | Hirose et al. |
| 4,863,557 A | 9/1989 | Kokaku et al. |
| 4,981,797 A | 1/1991 | Jessee et al. |
| 4,988,617 A | 1/1991 | Landegren et al. |
| 5,102,797 A | 4/1992 | Tucker et al. |
| 5,118,605 A | 6/1992 | Urdea |
| 5,137,814 A | 8/1992 | Rashtchian et al. |
| 5,143,854 A | 9/1992 | Pirrung et al. |
| 5,242,794 A | 9/1993 | Whiteley et al. |
| 5,242,974 A | 9/1993 | Holmes |
| 5,288,514 A | 2/1994 | Ellman |
| 5,299,491 A | 4/1994 | Kawada |
| 5,368,823 A | 11/1994 | McGraw et al. |
| 5,384,261 A | 1/1995 | Winkler et al. |
| 5,387,541 A | 2/1995 | Hodge et al. |
| 5,395,753 A | 3/1995 | Prakash |
| 5,431,720 A | 7/1995 | Nagai et al. |
| 5,445,934 A | 8/1995 | Fodor et al. |
| 5,449,754 A | 9/1995 | Nishioka |
| 5,459,039 A | 10/1995 | Modrich et al. |
| 5,474,796 A | 12/1995 | Brennan |
| 5,476,930 A | 12/1995 | Letsinger et al. |
| 5,487,993 A | 1/1996 | Herrnstadt et al. |
| 5,494,810 A | 2/1996 | Barany et al. |
| 5,501,893 A | 3/1996 | Laermer et al. |
| 5,508,169 A | 4/1996 | Deugau et al. |
| 5,510,270 A | 4/1996 | Fodor et al. |
| 5,514,789 A | 5/1996 | Kempe |
| 5,527,681 A | 6/1996 | Holmes |
| 5,530,516 A | 6/1996 | Sheets |
| 5,556,750 A | 9/1996 | Modrich et al. |
| 5,586,211 A | 12/1996 | Dumitrou et al. |
| 5,641,658 A | 6/1997 | Adams et al. |
| 5,677,195 A | 10/1997 | Winkler et al. |
| 5,679,522 A | 10/1997 | Modrich et al. |
| 5,683,879 A | 11/1997 | Laney et al. |
| 5,688,642 A | 11/1997 | Chrisey et al. |
| 5,700,637 A | 12/1997 | Southern |

(Continued)

FOREIGN PATENT DOCUMENTS

| | | |
|---|---|---|
| AU | 3157000 A | 9/2000 |
| CA | 2362939 A1 | 8/2000 |

(Continued)

OTHER PUBLICATIONS

Regep et al.,The H3 loop of antibodies shows unique structural characteristics. Proteins 85(7): 1311-1318, 2017.*
Fernández-Quintero et al., Characterizing the Diversity of the CDR-H3 Loop Conformational Ensembles in Relationship to Antibody Binding Properties. Front. Immunol., 9:1-11, 2019.*
Abudayyeh et al., C2c2 is a single-component programmable RNA-guided RNA-targeting CRISPR effector. Science, available on line, Jun. 13, 2016, at: http://zlab.mit.edu/assets/reprints/Abudayyeh_OO_Science_2016.pdf, 17 pages.
Acevedo-Rocha et al. Directed evolution of stereoselective enzymes based on genetic selection as opposed to screening systems. J. Biotechnol. 191:3-10 (2014).
Adessi, et al. Solid phase DNA amplification: characterisation of primer attachment and amplification mechanisms. Nucleic Acids Res. 28(20):E87, 2000.

(Continued)

*Primary Examiner* — Ruixiang Li
(74) *Attorney, Agent, or Firm* — Wilson Sonsini Goodrich & Rosati

(57) ABSTRACT

Provided herein are methods and compositions relating to G protein-coupled receptor (GPCR) libraries having nucleic acids encoding for a scaffold comprising a GPCR binding domain. Libraries described herein include variegated libraries comprising nucleic acids each encoding for a predetermined variant of at least one predetermined reference nucleic acid sequence. Further described herein are protein libraries generated when the nucleic acid libraries are translated. Further described herein are cell libraries expressing variegated nucleic acid libraries described herein.

10 Claims, 28 Drawing Sheets

Specification includes a Sequence Listing.

(56) References Cited

U.S. PATENT DOCUMENTS

| | | |
|---|---|---|
| 5,700,642 A | 12/1997 | Monforte et al. |
| 5,702,894 A | 12/1997 | Modrich et al. |
| 5,707,806 A | 1/1998 | Shuber |
| 5,712,124 A | 1/1998 | Walker |
| 5,712,126 A | 1/1998 | Weissman et al. |
| 5,739,386 A | 4/1998 | Holmes |
| 5,750,672 A | 5/1998 | Kempe |
| 5,780,613 A | 7/1998 | Letsinger et al. |
| 5,830,643 A | 11/1998 | Yamamoto et al. |
| 5,830,655 A | 11/1998 | Monforte et al. |
| 5,830,662 A | 11/1998 | Soares et al. |
| 5,834,252 A | 11/1998 | Stemmer et al. |
| 5,843,669 A | 12/1998 | Kaiser et al. |
| 5,843,767 A | 12/1998 | Beattie |
| 5,846,717 A | 12/1998 | Brow et al. |
| 5,854,033 A | 12/1998 | Lizardi |
| 5,858,754 A | 1/1999 | Modrich et al. |
| 5,861,482 A | 1/1999 | Modrich et al. |
| 5,863,801 A | 1/1999 | Southgate et al. |
| 5,869,245 A | 2/1999 | Yeung |
| 5,877,280 A | 3/1999 | Wetmur |
| 5,882,496 A | 3/1999 | Northrup et al. |
| 5,922,539 A | 7/1999 | Modrich et al. |
| 5,922,593 A | 7/1999 | Livingston |
| 5,928,907 A | 7/1999 | Woudenberg et al. |
| 5,962,272 A | 10/1999 | Chenchik et al. |
| 5,976,842 A | 11/1999 | Wurst |
| 5,976,846 A | 11/1999 | Passmore et al. |
| 5,989,872 A | 11/1999 | Luo et al. |
| 5,994,069 A | 11/1999 | Hall et al. |
| 6,001,567 A | 12/1999 | Brow et al. |
| 6,008,031 A | 12/1999 | Modrich et al. |
| 6,013,440 A | 1/2000 | Lipshutz et al. |
| 6,015,674 A | 1/2000 | Woudenberg et al. |
| 6,017,434 A | 1/2000 | Simpson et al. |
| 6,020,481 A | 2/2000 | Benson et al. |
| 6,027,898 A | 2/2000 | Gjerde et al. |
| 6,028,189 A | 2/2000 | Blanchard |
| 6,028,198 A | 2/2000 | Liu et al. |
| 6,040,138 A | 3/2000 | Lockhart et al. |
| 6,077,674 A | 6/2000 | Schleifer et al. |
| 6,087,482 A | 7/2000 | Teng et al. |
| 6,090,543 A | 7/2000 | Prudent et al. |
| 6,090,606 A | 7/2000 | Kaiser et al. |
| 6,103,474 A | 8/2000 | Dellinger et al. |
| 6,107,038 A | 8/2000 | Choudhary et al. |
| 6,110,682 A | 8/2000 | Dellinger et al. |
| 6,114,115 A | 9/2000 | Wagner, Jr. |
| 6,130,045 A | 10/2000 | Wurst et al. |
| 6,132,997 A | 10/2000 | Shannon |
| 6,136,568 A | 10/2000 | Hiatt et al. |
| 6,171,797 B1 | 1/2001 | Perbost |
| 6,180,351 B1 | 1/2001 | Cattell |
| 6,201,112 B1 | 3/2001 | Ach |
| 6,218,118 B1 | 4/2001 | Sampson et al. |
| 6,221,653 B1 | 4/2001 | Caren et al. |
| 6,222,030 B1 | 4/2001 | Dellinger et al. |
| 6,232,072 B1 | 5/2001 | Fisher |
| 6,235,483 B1 | 5/2001 | Wolber et al. |
| 6,242,266 B1 | 6/2001 | Schleifer et al. |
| 6,251,588 B1 | 6/2001 | Shannon et al. |
| 6,251,595 B1 | 6/2001 | Gordon et al. |
| 6,251,685 B1 | 6/2001 | Dorsel et al. |
| 6,258,454 B1 | 7/2001 | Lefkowitz et al. |
| 6,262,490 B1 | 7/2001 | Hsu et al. |
| 6,274,725 B1 | 8/2001 | Sanghvi et al. |
| 6,284,465 B1 | 9/2001 | Wolber |
| 6,287,776 B1 | 9/2001 | Hefti |
| 6,287,824 B1 | 9/2001 | Lizardi |
| 6,297,017 B1 | 10/2001 | Schmidt et al. |
| 6,300,137 B1 | 10/2001 | Earhart et al. |
| 6,306,599 B1 | 10/2001 | Perbost |
| 6,309,822 B1 | 10/2001 | Fodor et al. |
| 6,309,828 B1 | 10/2001 | Schleifer et al. |
| 6,312,911 B1 | 11/2001 | Bancroft et al. |
| 6,319,674 B1 | 11/2001 | Fulcrand et al. |
| 6,323,043 B1 | 11/2001 | Caren et al. |
| 6,329,210 B1 | 12/2001 | Schleifer |
| 6,346,423 B1 | 2/2002 | Schembri |
| 6,365,355 B1 | 4/2002 | McCutchen-Maloney |
| 6,372,483 B2 | 4/2002 | Schleifer et al. |
| 6,375,903 B1 | 4/2002 | Cerrina et al. |
| 6,376,285 B1 | 4/2002 | Joyner et al. |
| 6,384,210 B1 | 5/2002 | Blanchard |
| 6,387,636 B1 | 5/2002 | Perbost et al. |
| 6,399,394 B1 | 6/2002 | Dahm et al. |
| 6,399,516 B1 | 6/2002 | Ayon |
| 6,403,314 B1 | 6/2002 | Lange et al. |
| 6,406,849 B1 | 6/2002 | Dorsel et al. |
| 6,406,851 B1 | 6/2002 | Bass |
| 6,408,308 B1 | 6/2002 | Maslyn et al. |
| 6,419,883 B1 | 7/2002 | Blanchard |
| 6,428,957 B1 | 8/2002 | Delenstarr |
| 6,440,669 B1 | 8/2002 | Bass et al. |
| 6,444,268 B2 | 9/2002 | Lefkowitz et al. |
| 6,446,642 B1 | 9/2002 | Caren et al. |
| 6,446,682 B1 | 9/2002 | Viken |
| 6,451,998 B1 | 9/2002 | Perbost |
| 6,458,526 B1 | 10/2002 | Schembri et al. |
| 6,458,535 B1 | 10/2002 | Hall et al. |
| 6,458,583 B1 | 10/2002 | Bruhn et al. |
| 6,461,812 B2 | 10/2002 | Barth et al. |
| 6,461,816 B1 | 10/2002 | Wolber et al. |
| 6,469,156 B1 | 10/2002 | Schafer et al. |
| 6,472,147 B1 | 10/2002 | Janda et al. |
| 6,492,107 B1 | 12/2002 | Kauffman et al. |
| 6,518,056 B2 | 2/2003 | Schembri et al. |
| 6,521,427 B1 | 2/2003 | Evans |
| 6,521,453 B1 | 2/2003 | Crameri et al. |
| 6,555,357 B1 | 4/2003 | Kaiser et al. |
| 6,558,908 B2 | 5/2003 | Wolber et al. |
| 6,562,611 B1 | 5/2003 | Kaiser et al. |
| 6,566,495 B1 | 5/2003 | Fodor et al. |
| 6,582,908 B2 | 6/2003 | Fodor et al. |
| 6,582,938 B1 | 6/2003 | Su et al. |
| 6,586,211 B1 | 7/2003 | Staehler et al. |
| 6,587,579 B1 | 7/2003 | Bass |
| 6,589,739 B2 | 7/2003 | Fisher |
| 6,599,693 B1 | 7/2003 | Webb |
| 6,602,472 B1 | 8/2003 | Zimmermann et al. |
| 6,610,978 B2 | 8/2003 | Yin et al. |
| 6,613,513 B1 | 9/2003 | Parce et al. |
| 6,613,523 B2 | 9/2003 | Fischer |
| 6,613,560 B1 | 9/2003 | Tso et al. |
| 6,613,893 B1 | 9/2003 | Webb |
| 6,621,076 B1 | 9/2003 | Van De Goor et al. |
| 6,630,581 B2 | 10/2003 | Dellinger et al. |
| 6,632,641 B1 | 10/2003 | Brennan et al. |
| 6,635,226 B1 | 10/2003 | Tso et al. |
| 6,642,373 B2 | 11/2003 | Manoharan et al. |
| 6,649,348 B2 | 11/2003 | Bass et al. |
| 6,660,338 B1 | 12/2003 | Hargreaves |
| 6,664,112 B2 | 12/2003 | Mulligan et al. |
| 6,670,127 B2 | 12/2003 | Evans |
| 6,670,461 B1 | 12/2003 | Wengel et al. |
| 6,673,552 B2 | 1/2004 | Frey |
| 6,682,702 B2 | 1/2004 | Barth et al. |
| 6,689,319 B1 | 2/2004 | Fisher et al. |
| 6,692,917 B2 | 2/2004 | Neri et al. |
| 6,702,256 B2 | 3/2004 | Killeen et al. |
| 6,706,471 B1 | 3/2004 | Brow et al. |
| 6,706,875 B1 | 3/2004 | Goldberg et al. |
| 6,709,841 B2 | 3/2004 | Short |
| 6,709,852 B1 | 3/2004 | Bloom et al. |
| 6,709,854 B2 | 3/2004 | Donahue et al. |
| 6,713,262 B2 | 3/2004 | Gillibolian et al. |
| 6,716,629 B2 | 4/2004 | Hess et al. |
| 6,716,634 B1 | 4/2004 | Myerson |
| 6,723,509 B2 | 4/2004 | Ach |
| 6,728,129 B2 | 4/2004 | Lindsey et al. |
| 6,743,585 B2 | 6/2004 | Dellinger et al. |
| 6,753,145 B2 | 6/2004 | Holcomb et al. |
| 6,768,005 B2 | 7/2004 | Mellor et al. |
| 6,770,748 B2 | 8/2004 | Imanishi et al. |

(56) References Cited

U.S. PATENT DOCUMENTS

| | | |
|---|---|---|
| 6,770,892 B2 | 8/2004 | Corson et al. |
| 6,773,676 B2 | 8/2004 | Schembri |
| 6,773,888 B2 | 8/2004 | Li et al. |
| 6,780,982 B2 | 8/2004 | Lyamichev et al. |
| 6,787,308 B2 | 9/2004 | Balasubramanian et al. |
| 6,789,965 B2 | 9/2004 | Barth et al. |
| 6,790,620 B2 | 9/2004 | Bass et al. |
| 6,794,499 B2 | 9/2004 | Wengel et al. |
| 6,796,634 B2 | 9/2004 | Caren et al. |
| 6,800,439 B1 | 10/2004 | McGall et al. |
| 6,814,846 B1 | 11/2004 | Berndt |
| 6,815,218 B1 | 11/2004 | Jacobson et al. |
| 6,824,866 B1 | 11/2004 | Glazer et al. |
| 6,830,890 B2 | 12/2004 | Lockhart et al. |
| 6,833,246 B2 | 12/2004 | Balasubramanian |
| 6,833,450 B1 | 12/2004 | McGall et al. |
| 6,835,938 B2 | 12/2004 | Ghosh et al. |
| 6,838,888 B2 | 1/2005 | Peck |
| 6,841,131 B2 | 1/2005 | Zimmermann et al. |
| 6,845,968 B2 | 1/2005 | Killeen et al. |
| 6,846,454 B2 | 1/2005 | Peck |
| 6,846,922 B1 | 1/2005 | Manoharan et al. |
| 6,852,850 B2 | 2/2005 | Myerson et al. |
| 6,858,720 B2 | 2/2005 | Myerson et al. |
| 6,879,915 B2 | 4/2005 | Cattell |
| 6,880,576 B2 | 4/2005 | Karp et al. |
| 6,884,580 B2 | 4/2005 | Caren et al. |
| 6,887,715 B2 | 5/2005 | Schembri |
| 6,890,723 B2 | 5/2005 | Perbost et al. |
| 6,890,760 B1 | 5/2005 | Webb |
| 6,893,816 B1 | 5/2005 | Beattie |
| 6,897,023 B2 | 5/2005 | Fu et al. |
| 6,900,047 B2 | 5/2005 | Bass |
| 6,900,048 B2 | 5/2005 | Perbost |
| 6,911,611 B2 | 6/2005 | Wong et al. |
| 6,914,229 B2 | 7/2005 | Corson et al. |
| 6,916,113 B2 | 7/2005 | Van De Goor et al. |
| 6,916,633 B1 | 7/2005 | Shannon |
| 6,919,181 B2 | 7/2005 | Hargreaves |
| 6,927,029 B2 | 8/2005 | Lefkowitz et al. |
| 6,929,951 B2 | 8/2005 | Corson et al. |
| 6,936,472 B2 | 8/2005 | Earhart et al. |
| 6,938,476 B2 | 9/2005 | Chesk |
| 6,939,673 B2 | 9/2005 | Bass et al. |
| 6,943,036 B2 | 9/2005 | Bass |
| 6,946,285 B2 | 9/2005 | Bass |
| 6,950,756 B2 | 9/2005 | Kincaid |
| 6,951,719 B1 | 10/2005 | Dupret et al. |
| 6,958,119 B2 | 10/2005 | Yin et al. |
| 6,960,464 B2 | 11/2005 | Jessee et al. |
| 6,969,449 B2 | 11/2005 | Maher et al. |
| 6,969,488 B2 | 11/2005 | Bridgham et al. |
| 6,976,384 B2 | 12/2005 | Hobbs et al. |
| 6,977,223 B2 | 12/2005 | George et al. |
| 6,987,263 B2 | 1/2006 | Hobbs et al. |
| 6,989,267 B2 | 1/2006 | Kim et al. |
| 6,991,922 B2 | 1/2006 | Dupret et al. |
| 7,008,037 B2 | 3/2006 | Caren et al. |
| 7,025,324 B1 | 4/2006 | Slocum et al. |
| 7,026,124 B2 | 4/2006 | Barth et al. |
| 7,027,930 B2 | 4/2006 | Cattell |
| 7,028,536 B2 | 4/2006 | Karp et al. |
| 7,029,854 B2 | 4/2006 | Collins et al. |
| 7,034,290 B2 | 4/2006 | Lu et al. |
| 7,041,445 B2 | 5/2006 | Chenchik et al. |
| 7,045,289 B2 | 5/2006 | Allawi et al. |
| 7,051,574 B2 | 5/2006 | Peck |
| 7,052,841 B2 | 5/2006 | Delenstarr |
| 7,062,385 B2 | 6/2006 | White et al. |
| 7,064,197 B1 | 6/2006 | Rabbani et al. |
| 7,070,932 B2 | 7/2006 | Leproust et al. |
| 7,075,161 B2 | 7/2006 | Barth |
| 7,078,167 B2 | 7/2006 | Delenstarr et al. |
| 7,078,505 B2 | 7/2006 | Bass et al. |
| 7,094,537 B2 | 8/2006 | Leproust et al. |
| 7,097,974 B1 | 8/2006 | Staehler et al. |
| 7,101,508 B2 | 9/2006 | Thompson et al. |
| 7,101,986 B2 | 9/2006 | Dellinger et al. |
| 7,105,295 B2 | 9/2006 | Bass et al. |
| 7,115,423 B1 | 10/2006 | Mitchell |
| 7,122,303 B2 | 10/2006 | Delenstarr et al. |
| 7,122,364 B2 | 10/2006 | Lyamichev et al. |
| 7,125,488 B2 | 10/2006 | Li |
| 7,125,523 B2 | 10/2006 | Sillman |
| 7,128,876 B2 | 10/2006 | Yin et al. |
| 7,129,075 B2 | 10/2006 | Gerard et al. |
| 7,135,565 B2 | 11/2006 | Dellinger et al. |
| 7,138,062 B2 | 11/2006 | Yin et al. |
| 7,141,368 B2 | 11/2006 | Fisher et al. |
| 7,141,807 B2 | 11/2006 | Joyce et al. |
| 7,147,362 B2 | 12/2006 | Caren et al. |
| 7,150,982 B2 | 12/2006 | Allawi et al. |
| 7,153,689 B2 | 12/2006 | Tolosko et al. |
| 7,163,660 B2 | 1/2007 | Lehmann |
| 7,166,258 B2 | 1/2007 | Bass et al. |
| 7,179,659 B2 | 2/2007 | Stolowitz et al. |
| 7,183,406 B2 | 2/2007 | Belshaw et al. |
| 7,192,710 B2 | 3/2007 | Gellibolian et al. |
| 7,193,077 B2 | 3/2007 | Dellinger et al. |
| 7,195,872 B2 | 3/2007 | Agrawal et al. |
| 7,198,939 B2 | 4/2007 | Dorsel et al. |
| 7,202,264 B2 | 4/2007 | Ravikumar et al. |
| 7,202,358 B2 | 4/2007 | Hargreaves |
| 7,205,128 B2 | 4/2007 | Ilsley et al. |
| 7,205,400 B2 | 4/2007 | Webb |
| 7,206,439 B2 | 4/2007 | Zhou et al. |
| 7,208,322 B2 | 4/2007 | Stolowitz et al. |
| 7,217,522 B2 | 5/2007 | Brenner |
| 7,220,573 B2 | 5/2007 | Shea et al. |
| 7,221,785 B2 | 5/2007 | Curry et al. |
| 7,226,862 B2 | 6/2007 | Staehler et al. |
| 7,227,017 B2 | 6/2007 | Mellor et al. |
| 7,229,497 B2 | 6/2007 | Stott et al. |
| 7,247,337 B1 | 7/2007 | Leproust et al. |
| 7,247,497 B2 | 7/2007 | Dahm et al. |
| 7,252,938 B2 | 8/2007 | Leproust et al. |
| 7,269,518 B2 | 9/2007 | Corson |
| 7,271,258 B2 | 9/2007 | Dellinger et al. |
| 7,276,336 B1 | 10/2007 | Webb et al. |
| 7,276,378 B2 | 10/2007 | Myerson |
| 7,276,599 B2 | 10/2007 | Moore et al. |
| 7,282,183 B2 | 10/2007 | Peck |
| 7,282,332 B2 | 10/2007 | Caren et al. |
| 7,282,705 B2 | 10/2007 | Brennen |
| 7,291,471 B2 | 11/2007 | Sampson et al. |
| 7,302,348 B2 | 11/2007 | Ghosh et al. |
| 7,306,917 B2 | 12/2007 | Prudent et al. |
| 7,314,599 B2 | 1/2008 | Roitman et al. |
| 7,323,320 B2 | 1/2008 | Oleinikov |
| 7,344,831 B2 | 3/2008 | Wolber et al. |
| 7,348,144 B2 | 3/2008 | Minor |
| 7,351,379 B2 | 4/2008 | Schleifer |
| 7,353,116 B2 | 4/2008 | Webb et al. |
| 7,361,906 B2 | 4/2008 | Ghosh et al. |
| 7,364,896 B2 | 4/2008 | Schembri |
| 7,368,550 B2 | 5/2008 | Dellinger et al. |
| 7,371,348 B2 | 5/2008 | Schleifer et al. |
| 7,371,519 B2 | 5/2008 | Wolber et al. |
| 7,371,580 B2 | 5/2008 | Yakhini et al. |
| 7,372,982 B2 | 5/2008 | Le Cocq |
| 7,384,746 B2 | 6/2008 | Lyamichev et al. |
| 7,385,050 B2 | 6/2008 | Dellinger et al. |
| 7,390,457 B2 | 6/2008 | Schembri |
| 7,393,665 B2 | 7/2008 | Brenner |
| 7,396,676 B2 | 7/2008 | Robotti et al. |
| 7,399,844 B2 | 7/2008 | Sampson et al. |
| 7,402,279 B2 | 7/2008 | Schembri |
| 7,411,061 B2 | 8/2008 | Myerson et al. |
| 7,413,709 B2 | 8/2008 | Roitman et al. |
| 7,417,139 B2 | 8/2008 | Dellinger et al. |
| 7,422,911 B2 | 9/2008 | Schembri |
| 7,427,679 B2 | 9/2008 | Dellinger et al. |
| 7,432,048 B2 | 10/2008 | Neri et al. |
| 7,435,810 B2 | 10/2008 | Myerson et al. |

(56) References Cited

U.S. PATENT DOCUMENTS

| | | |
|---|---|---|
| 7,439,272 B2 | 10/2008 | Xu |
| 7,476,709 B2 | 1/2009 | Moody et al. |
| 7,482,118 B2 | 1/2009 | Allawi et al. |
| 7,488,607 B2 | 2/2009 | Tom-Moy et al. |
| 7,504,213 B2 | 3/2009 | Sana et al. |
| 7,514,369 B2 | 4/2009 | Li et al. |
| 7,517,979 B2 | 4/2009 | Wolber |
| 7,524,942 B2 | 4/2009 | Wang et al. |
| 7,524,950 B2 | 4/2009 | Dellinger et al. |
| 7,527,928 B2 | 5/2009 | Neri et al. |
| 7,531,303 B2 | 5/2009 | Dorsel et al. |
| 7,534,561 B2 | 5/2009 | Sana et al. |
| 7,534,563 B2 | 5/2009 | Hargreaves |
| 7,537,936 B2 | 5/2009 | Dahm et al. |
| 7,541,145 B2 | 6/2009 | Prudent et al. |
| 7,544,473 B2 | 6/2009 | Brenner |
| 7,556,919 B2 | 7/2009 | Chenchik et al. |
| 7,563,600 B2 | 7/2009 | Oleinikov |
| 7,572,585 B2 | 8/2009 | Wang |
| 7,572,907 B2 | 8/2009 | Dellinger et al. |
| 7,572,908 B2 | 8/2009 | Dellinger et al. |
| 7,585,970 B2 | 9/2009 | Dellinger et al. |
| 7,588,889 B2 | 9/2009 | Wolber et al. |
| 7,595,350 B2 | 9/2009 | Xu |
| 7,604,941 B2 | 10/2009 | Jacobson |
| 7,604,996 B1 | 10/2009 | Stuelpnagel et al. |
| 7,608,396 B2 | 10/2009 | Delenstarr |
| 7,618,777 B2 | 11/2009 | Myerson et al. |
| 7,629,120 B2 | 12/2009 | Bennett et al. |
| 7,635,772 B2 | 12/2009 | McCormac |
| 7,648,832 B2 | 1/2010 | Jessee et al. |
| 7,651,762 B2 | 1/2010 | Xu et al. |
| 7,659,069 B2 | 2/2010 | Belyaev et al. |
| 7,678,542 B2 | 3/2010 | Lyamichev et al. |
| 7,682,809 B2 | 3/2010 | Sampson |
| 7,709,197 B2 | 5/2010 | Drmanac |
| 7,718,365 B2 | 5/2010 | Wang |
| 7,718,786 B2 | 5/2010 | Dupret et al. |
| 7,723,077 B2 | 5/2010 | Young et al. |
| 7,737,088 B1 | 6/2010 | Staehler et al. |
| 7,737,089 B2 | 6/2010 | Guimil et al. |
| 7,741,463 B2 | 6/2010 | Gormley et al. |
| 7,749,701 B2 | 7/2010 | Leproust et al. |
| 7,759,471 B2 | 7/2010 | Dellinger et al. |
| 7,776,021 B2 | 8/2010 | Borenstein et al. |
| 7,776,532 B2 | 8/2010 | Gibson et al. |
| 7,790,369 B2 | 9/2010 | Stahler et al. |
| 7,790,387 B2 | 9/2010 | Dellinger et al. |
| 7,807,356 B2 | 10/2010 | Sampson et al. |
| 7,807,806 B2 | 10/2010 | Allawi et al. |
| 7,811,753 B2 | 10/2010 | Eshoo |
| 7,816,079 B2 | 10/2010 | Fischer |
| 7,820,387 B2 | 10/2010 | Neri et al. |
| 7,829,314 B2 | 11/2010 | Prudent et al. |
| 7,855,281 B2 | 12/2010 | Dellinger et al. |
| 7,862,999 B2 | 1/2011 | Zheng et al. |
| 7,867,782 B2 | 1/2011 | Barth |
| 7,875,463 B2 | 1/2011 | Adaskin et al. |
| 7,879,541 B2 | 2/2011 | Kincaid |
| 7,879,580 B2 | 2/2011 | Carr et al. |
| 7,894,998 B2 | 2/2011 | Kincaid |
| 7,919,239 B2 | 4/2011 | Wang |
| 7,919,308 B2 | 4/2011 | Schleifer |
| 7,927,797 B2 | 4/2011 | Nobile et al. |
| 7,927,838 B2 | 4/2011 | Shannon |
| 7,932,025 B2 | 4/2011 | Carr et al. |
| 7,932,070 B2 | 4/2011 | Hogrefe et al. |
| 7,935,800 B2 | 5/2011 | Allawi et al. |
| 7,939,645 B2 | 5/2011 | Borns |
| 7,943,046 B2 | 5/2011 | Martosella et al. |
| 7,943,358 B2 | 5/2011 | Hogrefe et al. |
| 7,960,157 B2 | 6/2011 | Borns |
| 7,977,119 B2 | 7/2011 | Kronick et al. |
| 7,979,215 B2 | 7/2011 | Sampas |
| 7,998,437 B2 | 8/2011 | Berndt et al. |
| 7,999,087 B2 | 8/2011 | Dellinger et al. |
| 8,021,842 B2 | 9/2011 | Brenner |
| 8,021,844 B2 | 9/2011 | Wang |
| 8,034,917 B2 | 10/2011 | Yamada |
| 8,036,835 B2 | 10/2011 | Sampas et al. |
| 8,048,664 B2 | 11/2011 | Guan et al. |
| 8,053,191 B2 | 11/2011 | Blake |
| 8,058,001 B2 | 11/2011 | Crameri et al. |
| 8,058,004 B2 | 11/2011 | Oleinikov |
| 8,058,055 B2 | 11/2011 | Barrett et al. |
| 8,063,184 B2 | 11/2011 | Allawi et al. |
| 8,067,556 B2 | 11/2011 | Hogrefe et al. |
| 8,073,626 B2 | 12/2011 | Troup et al. |
| 8,076,064 B2 | 12/2011 | Wang |
| 8,076,152 B2 | 12/2011 | Robotti |
| 8,097,711 B2 | 1/2012 | Timar et al. |
| 8,137,936 B2 | 3/2012 | Macevicz |
| 8,148,068 B2 | 4/2012 | Brenner |
| 8,154,729 B2 | 4/2012 | Baldo et al. |
| 8,168,385 B2 | 5/2012 | Brenner et al. |
| 8,168,388 B2 | 5/2012 | Gormley et al. |
| 8,173,368 B2 | 5/2012 | Staehler et al. |
| 8,182,991 B1 | 5/2012 | Kaiser et al. |
| 8,194,244 B2 | 6/2012 | Wang et al. |
| 8,198,071 B2 | 6/2012 | Goshoo et al. |
| 8,202,983 B2 | 6/2012 | Dellinger et al. |
| 8,202,985 B2 | 6/2012 | Dellinger et al. |
| 8,206,952 B2 | 6/2012 | Carr et al. |
| 8,213,015 B2 | 7/2012 | Kraiczek et al. |
| 8,242,258 B2 | 8/2012 | Dellinger et al. |
| 8,247,221 B2 | 8/2012 | Fawcett |
| 8,263,335 B2 | 9/2012 | Carr et al. |
| 8,268,605 B2 | 9/2012 | Sorge et al. |
| 8,283,148 B2 | 10/2012 | Sorge et al. |
| 8,288,093 B2 | 10/2012 | Hall et al. |
| 8,298,767 B2 | 10/2012 | Brenner et al. |
| 8,304,273 B2 | 11/2012 | Stellacci et al. |
| 8,309,307 B2 | 11/2012 | Barrett et al. |
| 8,309,706 B2 | 11/2012 | Dellinger et al. |
| 8,309,710 B2 | 11/2012 | Sierzchala et al. |
| 8,314,220 B2 | 11/2012 | Mullinax et al. |
| 8,318,433 B2 | 11/2012 | Brenner |
| 8,318,479 B2 | 11/2012 | Domansky et al. |
| 8,357,489 B2 | 1/2013 | Chua et al. |
| 8,357,490 B2 | 1/2013 | Froehlich et al. |
| 8,367,016 B2 | 2/2013 | Quan et al. |
| 8,367,335 B2 | 2/2013 | Staehler et al. |
| 8,380,441 B2 | 2/2013 | Webb et al. |
| 8,383,338 B2 | 2/2013 | Kitzman et al. |
| 8,415,138 B2 | 4/2013 | Leproust |
| 8,435,736 B2 | 5/2013 | Gibson et al. |
| 8,445,205 B2 | 5/2013 | Brenner |
| 8,445,206 B2 | 5/2013 | Bergmann et al. |
| 8,470,996 B2 | 6/2013 | Brenner et al. |
| 8,476,018 B2 | 7/2013 | Brenner |
| 8,476,598 B1 | 7/2013 | Pralle et al. |
| 8,481,292 B2 | 7/2013 | Casbon et al. |
| 8,481,309 B2 | 7/2013 | Zhang et al. |
| 8,491,561 B2 | 7/2013 | Borenstein et al. |
| 8,497,069 B2 | 7/2013 | Hutchison, III et al. |
| 8,500,979 B2 | 8/2013 | Elibol et al. |
| 8,501,454 B2 | 8/2013 | Liu et al. |
| 8,507,226 B2 | 8/2013 | Carr et al. |
| 8,507,239 B2 | 8/2013 | Lubys et al. |
| 8,507,272 B2 | 8/2013 | Zhang et al. |
| 8,530,197 B2 | 9/2013 | Li et al. |
| 8,552,174 B2 | 10/2013 | Dellinger et al. |
| 8,563,478 B2 | 10/2013 | Gormley et al. |
| 8,569,046 B2 | 10/2013 | Love et al. |
| 8,577,621 B2 | 11/2013 | Troup et al. |
| 8,586,310 B2 | 11/2013 | Mitra et al. |
| 8,614,092 B2 | 12/2013 | Zhang et al. |
| 8,642,755 B2 | 2/2014 | Sierzchala et al. |
| 8,664,164 B2 | 3/2014 | Ericsson et al. |
| 8,669,053 B2 | 3/2014 | Stuelpnagel et al. |
| 8,679,756 B1 | 3/2014 | Brenner et al. |
| 8,685,642 B2 | 4/2014 | Sampas |
| 8,685,676 B2 | 4/2014 | Hogrefe et al. |
| 8,685,678 B2 | 4/2014 | Casbon et al. |

(56) References Cited

U.S. PATENT DOCUMENTS

| | | |
|---|---|---|
| 8,715,933 B2 | 5/2014 | Oliver |
| 8,715,967 B2 | 5/2014 | Casbon et al. |
| 8,716,467 B2 | 5/2014 | Jacobson |
| 8,722,368 B2 | 5/2014 | Casbon et al. |
| 8,722,585 B2 | 5/2014 | Wang |
| 8,728,766 B2 | 5/2014 | Casbon et al. |
| 8,741,606 B2 | 6/2014 | Casbon et al. |
| 8,808,896 B2 | 8/2014 | Choo et al. |
| 8,808,986 B2 | 8/2014 | Jacobson et al. |
| 8,815,600 B2 | 8/2014 | Liu et al. |
| 8,889,851 B2 | 11/2014 | Leproust et al. |
| 8,932,994 B2 | 1/2015 | Gormley et al. |
| 8,962,532 B2 | 2/2015 | Shapiro et al. |
| 8,968,999 B2 | 3/2015 | Gibson et al. |
| 8,980,563 B2 | 3/2015 | Zheng et al. |
| 9,018,365 B2 | 4/2015 | Brenner et al. |
| 9,023,601 B2 | 5/2015 | Oleinikov |
| 9,051,666 B2 | 6/2015 | Oleinikov |
| 9,073,962 B2 | 7/2015 | Fracchia et al. |
| 9,074,204 B2 | 7/2015 | Anderson et al. |
| 9,085,797 B2 | 7/2015 | Gebeyehu et al. |
| 9,133,510 B2 | 9/2015 | Andersen et al. |
| 9,139,874 B2 | 9/2015 | Myers et al. |
| 9,150,853 B2 | 10/2015 | Hudson et al. |
| 9,187,777 B2 | 11/2015 | Jacobson et al. |
| 9,194,001 B2 | 11/2015 | Brenner |
| 9,216,414 B2 | 12/2015 | Chu |
| 9,217,144 B2 | 12/2015 | Jacobson et al. |
| 9,279,149 B2 | 3/2016 | Efcavitch et al. |
| 9,286,439 B2 | 3/2016 | Shapiro et al. |
| 9,295,965 B2 | 3/2016 | Jacobson et al. |
| 9,315,861 B2 | 4/2016 | Hendricks et al. |
| 9,328,378 B2 | 5/2016 | Earnshaw et al. |
| 9,347,091 B2 | 5/2016 | Bergmann et al. |
| 9,375,748 B2 | 6/2016 | Harumoto et al. |
| 9,376,677 B2 | 6/2016 | Mir |
| 9,376,678 B2 | 6/2016 | Gormley et al. |
| 9,384,320 B2 | 7/2016 | Church |
| 9,384,920 B1 | 7/2016 | Bakulich |
| 9,388,407 B2 | 7/2016 | Jacobson |
| 9,394,333 B2 | 7/2016 | Wada et al. |
| 9,403,141 B2 | 8/2016 | Banyai et al. |
| 9,409,139 B2 | 8/2016 | Banyai et al. |
| 9,410,149 B2 | 8/2016 | Brenner et al. |
| 9,410,173 B2 | 8/2016 | Betts et al. |
| 9,416,411 B2 | 8/2016 | Stuelpnagel et al. |
| 9,422,600 B2 | 8/2016 | Ramu et al. |
| 9,487,824 B2 | 11/2016 | Kutyavin et al. |
| 9,499,848 B2 | 11/2016 | Carr et al. |
| 9,523,122 B2 | 12/2016 | Zheng et al. |
| 9,528,148 B2 | 12/2016 | Zheng et al. |
| 9,534,251 B2 | 1/2017 | Young et al. |
| 9,555,388 B2 | 1/2017 | Banyai et al. |
| 9,568,839 B2 | 2/2017 | Stahler et al. |
| 9,580,746 B2 | 2/2017 | Leproust et al. |
| 9,670,529 B2 | 6/2017 | Osborne et al. |
| 9,670,536 B2 | 6/2017 | Casbon et al. |
| 9,677,067 B2 | 6/2017 | Toro et al. |
| 9,695,211 B2 | 7/2017 | Wada et al. |
| 9,718,060 B2 | 8/2017 | Venter et al. |
| 9,745,573 B2 | 8/2017 | Stuelpnagel et al. |
| 9,745,619 B2 | 8/2017 | Rabbani et al. |
| 9,765,387 B2 | 9/2017 | Rabbani et al. |
| 9,771,576 B2 | 9/2017 | Gibson et al. |
| 9,833,761 B2 | 12/2017 | Banyai et al. |
| 9,834,774 B2 | 12/2017 | Carstens |
| 9,839,894 B2 | 12/2017 | Banyai et al. |
| 9,879,283 B2 | 1/2018 | Ravinder et al. |
| 9,889,423 B2 | 2/2018 | Banyai et al. |
| 9,895,673 B2 | 2/2018 | Peck et al. |
| 9,925,510 B2 | 3/2018 | Jacobson et al. |
| 9,932,576 B2 | 4/2018 | Raymond et al. |
| 9,981,239 B2 | 5/2018 | Banyai |
| 10,053,688 B2 | 8/2018 | Cox |
| 10,251,611 B2 | 4/2019 | Marsh et al. |
| 10,583,415 B2 | 3/2020 | Banyai et al. |
| 2001/0018512 A1 | 8/2001 | Blanchard |
| 2001/0039014 A1 | 11/2001 | Bass et al. |
| 2001/0055761 A1 | 12/2001 | Kanemoto et al. |
| 2002/0012930 A1 | 1/2002 | Rothberg et al. |
| 2002/0025561 A1 | 2/2002 | Hodgson |
| 2002/0076716 A1 | 6/2002 | Sabanayagam et al. |
| 2002/0081582 A1 | 6/2002 | Gao et al. |
| 2002/0094533 A1 | 7/2002 | Hess et al. |
| 2002/0095073 A1 | 7/2002 | Jacobs et al. |
| 2002/0119459 A1 | 8/2002 | Griffiths et al. |
| 2002/0132308 A1 | 9/2002 | Liu et al. |
| 2002/0155439 A1 | 10/2002 | Rodriguez et al. |
| 2002/0160536 A1 | 10/2002 | Regnier et al. |
| 2002/0164824 A1 | 11/2002 | Xiao et al. |
| 2003/0008411 A1 | 1/2003 | Van Dam et al. |
| 2003/0022207 A1 | 1/2003 | Balasubramanian et al. |
| 2003/0022240 A1 | 1/2003 | Luo et al. |
| 2003/0022317 A1 | 1/2003 | Jack et al. |
| 2003/0044781 A1 | 3/2003 | Korlach et al. |
| 2003/0058629 A1 | 3/2003 | Hirai et al. |
| 2003/0064398 A1 | 4/2003 | Barnes |
| 2003/0068633 A1 | 4/2003 | Belshaw et al. |
| 2003/0082719 A1 | 5/2003 | Schumacher et al. |
| 2003/0100102 A1 | 5/2003 | Rothberg et al. |
| 2003/0108903 A1 | 6/2003 | Wang et al. |
| 2003/0120035 A1 | 6/2003 | Gao et al. |
| 2003/0130827 A1 | 7/2003 | Bentzien et al. |
| 2003/0138782 A1 | 7/2003 | Evans |
| 2003/0143605 A1 | 7/2003 | Lok et al. |
| 2003/0148291 A1 | 8/2003 | Robotti |
| 2003/0148344 A1 | 8/2003 | Rothberg et al. |
| 2003/0171325 A1 | 9/2003 | Gascoyne et al. |
| 2003/0186226 A1 | 10/2003 | Brennan et al. |
| 2003/0228602 A1 | 12/2003 | Parker et al. |
| 2003/0228620 A1 | 12/2003 | Du Breuil Lastrucci |
| 2004/0009498 A1 | 1/2004 | Short |
| 2004/0043509 A1 | 3/2004 | Stahler et al. |
| 2004/0053362 A1 | 3/2004 | De Luca et al. |
| 2004/0086892 A1 | 5/2004 | Crothers et al. |
| 2004/0087008 A1 | 5/2004 | Schembri |
| 2004/0106130 A1 | 6/2004 | Besemer et al. |
| 2004/0106728 A1 | 6/2004 | McGall et al. |
| 2004/0110133 A1 | 6/2004 | Xu et al. |
| 2004/0175710 A1 | 9/2004 | Haushalter |
| 2004/0175734 A1 | 9/2004 | Stahler et al. |
| 2004/0191810 A1 | 9/2004 | Yamamoto |
| 2004/0213795 A1 | 10/2004 | Collins et al. |
| 2004/0219663 A1 | 11/2004 | Page et al. |
| 2004/0236027 A1 | 11/2004 | Maeji et al. |
| 2004/0248161 A1 | 12/2004 | Rothberg et al. |
| 2004/0253242 A1 | 12/2004 | Bowdish et al. |
| 2004/0259146 A1 | 12/2004 | Friend et al. |
| 2005/0022895 A1 | 2/2005 | Barth et al. |
| 2005/0049402 A1 | 3/2005 | Babcook et al. |
| 2005/0049796 A1 | 3/2005 | Webb et al. |
| 2005/0053968 A1 | 3/2005 | Bharadwaj et al. |
| 2005/0079510 A1 | 4/2005 | Berka et al. |
| 2005/0100932 A1 | 5/2005 | Lapidus et al. |
| 2005/0112608 A1 | 5/2005 | Grossman et al. |
| 2005/0112636 A1 | 5/2005 | Hurt et al. |
| 2005/0112679 A1 | 5/2005 | Myerson et al. |
| 2005/0124022 A1 | 6/2005 | Srinivasan et al. |
| 2005/0137805 A1 | 6/2005 | Lewin et al. |
| 2005/0208513 A1 | 9/2005 | Agbo et al. |
| 2005/0214778 A1 | 9/2005 | Peck et al. |
| 2005/0214779 A1 | 9/2005 | Peck et al. |
| 2005/0227235 A1 | 10/2005 | Carr et al. |
| 2005/0255477 A1 | 11/2005 | Carr et al. |
| 2005/0266045 A1 | 12/2005 | Canham et al. |
| 2005/0277125 A1 | 12/2005 | Benn et al. |
| 2005/0282158 A1 | 12/2005 | Landegren |
| 2005/0287585 A1 | 12/2005 | Oleinikov |
| 2006/0003381 A1 | 1/2006 | Gilmore et al. |
| 2006/0003958 A1 | 1/2006 | Melville et al. |
| 2006/0012784 A1 | 1/2006 | Ulmer |
| 2006/0012793 A1 | 1/2006 | Harris |
| 2006/0019084 A1 | 1/2006 | Pearson |
| 2006/0024678 A1 | 2/2006 | Buzby |

(56) References Cited

U.S. PATENT DOCUMENTS

| | | |
|---|---|---|
| 2006/0024711 A1 | 2/2006 | Lapidus et al. |
| 2006/0024721 A1 | 2/2006 | Pedersen |
| 2006/0076482 A1 | 4/2006 | Hobbs et al. |
| 2006/0078909 A1 | 4/2006 | Srinivasan et al. |
| 2006/0078927 A1 | 4/2006 | Peck et al. |
| 2006/0078937 A1 | 4/2006 | Korlach et al. |
| 2006/0127920 A1 | 6/2006 | Church et al. |
| 2006/0134638 A1 | 6/2006 | Mulligan et al. |
| 2006/0160138 A1 | 7/2006 | Church |
| 2006/0171855 A1 | 8/2006 | Yin et al. |
| 2006/0202330 A1 | 9/2006 | Reinhardt et al. |
| 2006/0203236 A1 | 9/2006 | Ji et al. |
| 2006/0203237 A1 | 9/2006 | Ji et al. |
| 2006/0207923 A1 | 9/2006 | Li |
| 2006/0219637 A1 | 10/2006 | Killeen et al. |
| 2007/0031857 A1 | 2/2007 | Makarov et al. |
| 2007/0031877 A1 | 2/2007 | Stahler et al. |
| 2007/0043516 A1 | 2/2007 | Gustafsson et al. |
| 2007/0054127 A1 | 3/2007 | Hergenrother et al. |
| 2007/0059692 A1 | 3/2007 | Gao et al. |
| 2007/0087349 A1 | 4/2007 | Staehler et al. |
| 2007/0099196 A1 | 5/2007 | Kauppinen et al. |
| 2007/0099208 A1 | 5/2007 | Drmanac et al. |
| 2007/0122817 A1 | 5/2007 | Church et al. |
| 2007/0128635 A1 | 6/2007 | Macevicz |
| 2007/0141557 A1 | 6/2007 | Raab et al. |
| 2007/0196834 A1 | 8/2007 | Cerrina et al. |
| 2007/0196854 A1 | 8/2007 | Stahler et al. |
| 2007/0207482 A1 | 9/2007 | Church et al. |
| 2007/0207487 A1 | 9/2007 | Emig et al. |
| 2007/0231800 A1 | 10/2007 | Roberts et al. |
| 2007/0233403 A1 | 10/2007 | Alwan et al. |
| 2007/0238104 A1 | 10/2007 | Barrett et al. |
| 2007/0238106 A1 | 10/2007 | Barrett et al. |
| 2007/0238108 A1 | 10/2007 | Barrett et al. |
| 2007/0259344 A1 | 11/2007 | Leproust et al. |
| 2007/0259345 A1 | 11/2007 | Sampas |
| 2007/0259346 A1 | 11/2007 | Gordon et al. |
| 2007/0259347 A1 | 11/2007 | Gordon et al. |
| 2007/0269870 A1 | 11/2007 | Church et al. |
| 2008/0085511 A1 | 4/2008 | Peck et al. |
| 2008/0085514 A1 | 4/2008 | Peck et al. |
| 2008/0087545 A1 | 4/2008 | Jensen et al. |
| 2008/0161200 A1 | 7/2008 | Yu et al. |
| 2008/0182296 A1 | 7/2008 | Chanda et al. |
| 2008/0214412 A1 | 9/2008 | Stahler et al. |
| 2008/0227160 A1 | 9/2008 | Kool |
| 2008/0233616 A1 | 9/2008 | Liss |
| 2008/0287320 A1 | 11/2008 | Baynes et al. |
| 2008/0300842 A1 | 12/2008 | Govindarajan et al. |
| 2008/0308884 A1 | 12/2008 | Kalvesten |
| 2008/0311628 A1 | 12/2008 | Shoemaker |
| 2009/0036664 A1 | 2/2009 | Peter |
| 2009/0053704 A1 | 2/2009 | Novoradovskaya et al. |
| 2009/0062129 A1 | 3/2009 | McKernan et al. |
| 2009/0074771 A1 | 3/2009 | Koenig et al. |
| 2009/0087840 A1 | 4/2009 | Baynes et al. |
| 2009/0088679 A1 | 4/2009 | Wood et al. |
| 2009/0105094 A1 | 4/2009 | Heiner et al. |
| 2009/0170802 A1 | 7/2009 | Stahler et al. |
| 2009/0176280 A1 | 7/2009 | Hutchison, III et al. |
| 2009/0181861 A1 | 7/2009 | Li et al. |
| 2009/0194483 A1 | 8/2009 | Robotti et al. |
| 2009/0230044 A1 | 9/2009 | Bek |
| 2009/0238722 A1 | 9/2009 | Mora-Fillat et al. |
| 2009/0239759 A1 | 9/2009 | Balch |
| 2009/0246788 A1 | 10/2009 | Albert et al. |
| 2009/0263802 A1 | 10/2009 | Drmanac |
| 2009/0285825 A1 | 11/2009 | Kini et al. |
| 2009/0324546 A1 | 12/2009 | Notka et al. |
| 2010/0004143 A1 | 1/2010 | Shibahara |
| 2010/0008851 A1 | 1/2010 | Nicolaides et al. |
| 2010/0009872 A1 | 1/2010 | Eid et al. |
| 2010/0047805 A1 | 2/2010 | Wang |
| 2010/0051967 A1 | 3/2010 | Bradley et al. |
| 2010/0069250 A1 | 3/2010 | White, III et al. |
| 2010/0090341 A1 | 4/2010 | Wan et al. |
| 2010/0099103 A1 | 4/2010 | Hsieh et al. |
| 2010/0111768 A1 | 5/2010 | Banerjee et al. |
| 2010/0160463 A1 | 6/2010 | Wang et al. |
| 2010/0167950 A1 | 7/2010 | Juang et al. |
| 2010/0173364 A1 | 7/2010 | Evans, Jr. et al. |
| 2010/0216648 A1 | 8/2010 | Staehler et al. |
| 2010/0256017 A1 | 10/2010 | Larman et al. |
| 2010/0258487 A1 | 10/2010 | Zelechonok et al. |
| 2010/0272711 A1 | 10/2010 | Feldman et al. |
| 2010/0286290 A1 | 11/2010 | Lohmann et al. |
| 2010/0292102 A1 | 11/2010 | Nouri |
| 2010/0300882 A1 | 12/2010 | Zhang et al. |
| 2010/0323404 A1 | 12/2010 | Lathrop |
| 2011/0009607 A1 | 1/2011 | Komiyama et al. |
| 2011/0082055 A1 | 4/2011 | Fox et al. |
| 2011/0114244 A1 | 5/2011 | Yoo et al. |
| 2011/0114549 A1 | 5/2011 | Yin et al. |
| 2011/0124049 A1 | 5/2011 | Li et al. |
| 2011/0124055 A1 | 5/2011 | Carr et al. |
| 2011/0126929 A1 | 6/2011 | Velasquez-Garcia et al. |
| 2011/0171651 A1 | 7/2011 | Richmond |
| 2011/0172127 A1 | 7/2011 | Jacobson et al. |
| 2011/0201057 A1 | 8/2011 | Carr et al. |
| 2011/0217738 A1 | 9/2011 | Jacobson |
| 2011/0230653 A1 | 9/2011 | Novoradovskaya et al. |
| 2011/0254107 A1 | 10/2011 | Bulovic et al. |
| 2011/0287435 A1 | 11/2011 | Grunenwald et al. |
| 2012/0003713 A1 | 1/2012 | Hansen et al. |
| 2012/0021932 A1 | 1/2012 | Mershin et al. |
| 2012/0027786 A1 | 2/2012 | Gupta et al. |
| 2012/0028843 A1 | 2/2012 | Ramu et al. |
| 2012/0032366 A1 | 2/2012 | Ivniski et al. |
| 2012/0046175 A1 | 2/2012 | Rodesch et al. |
| 2012/0050411 A1 | 3/2012 | Mabritto et al. |
| 2012/0094847 A1 | 4/2012 | Warthmann et al. |
| 2012/0128548 A1 | 5/2012 | West et al. |
| 2012/0129704 A1 | 5/2012 | Gunderson et al. |
| 2012/0149602 A1 | 6/2012 | Friend et al. |
| 2012/0164127 A1 | 6/2012 | Short et al. |
| 2012/0164633 A1 | 6/2012 | Laffler |
| 2012/0164691 A1 | 6/2012 | Eshoo et al. |
| 2012/0184724 A1 | 7/2012 | Sierzchala et al. |
| 2012/0220497 A1 | 8/2012 | Jacobson et al. |
| 2012/0231968 A1 | 9/2012 | Bruhn et al. |
| 2012/0238737 A1 | 9/2012 | Dellinger et al. |
| 2012/0258487 A1 | 10/2012 | Chang et al. |
| 2012/0264653 A1 | 10/2012 | Carr et al. |
| 2012/0270750 A1 | 10/2012 | Oleinikov |
| 2012/0270754 A1 | 10/2012 | Blake |
| 2012/0283140 A1 | 11/2012 | Chu |
| 2012/0288476 A1 | 11/2012 | Hartmann et al. |
| 2012/0289691 A1 | 11/2012 | Dellinger et al. |
| 2012/0315670 A1 | 12/2012 | Jacobson et al. |
| 2012/0322681 A1 | 12/2012 | Kung et al. |
| 2013/0005585 A1 | 1/2013 | Anderson et al. |
| 2013/0005612 A1 | 1/2013 | Carr et al. |
| 2013/0014790 A1 | 1/2013 | Van Gerpen |
| 2013/0017642 A1 | 1/2013 | Milgrew et al. |
| 2013/0017977 A1 | 1/2013 | Oleinikov |
| 2013/0017978 A1 | 1/2013 | Kavanagh et al. |
| 2013/0035261 A1 | 2/2013 | Sierzchala et al. |
| 2013/0040836 A1 | 2/2013 | Himmler et al. |
| 2013/0045483 A1 | 2/2013 | Treusch et al. |
| 2013/0053252 A1 | 2/2013 | Xie et al. |
| 2013/0059296 A1 | 3/2013 | Jacobson et al. |
| 2013/0059761 A1 | 3/2013 | Jacobson et al. |
| 2013/0065017 A1 | 3/2013 | Sieber |
| 2013/0109595 A1 | 5/2013 | Routenberg |
| 2013/0109596 A1 | 5/2013 | Peterson et al. |
| 2013/0123129 A1 | 5/2013 | Zeiner et al. |
| 2013/0130321 A1 | 5/2013 | Staehler et al. |
| 2013/0137161 A1 | 5/2013 | Zhang et al. |
| 2013/0137173 A1 | 5/2013 | Zhang et al. |
| 2013/0137174 A1 | 5/2013 | Zhang et al. |
| 2013/0137861 A1 | 5/2013 | Leproust et al. |
| 2013/0164308 A1 | 6/2013 | Foletti et al. |
| 2013/0165328 A1 | 6/2013 | Previte et al. |

(56) References Cited

U.S. PATENT DOCUMENTS

| | | |
|---|---|---|
| 2013/0196864 A1 | 8/2013 | Govindarajan et al. |
| 2013/0225421 A1 | 8/2013 | Li et al. |
| 2013/0244884 A1 | 9/2013 | Jacobson et al. |
| 2013/0252849 A1 | 9/2013 | Hudson et al. |
| 2013/0261027 A1 | 10/2013 | Li et al. |
| 2013/0281308 A1 | 10/2013 | Kung et al. |
| 2013/0289246 A1 | 10/2013 | Crowe et al. |
| 2013/0296192 A1 | 11/2013 | Jacobson et al. |
| 2013/0296194 A1 | 11/2013 | Jacobson et al. |
| 2013/0298265 A1 | 11/2013 | Cunnac et al. |
| 2013/0309725 A1 | 11/2013 | Jacobson et al. |
| 2013/0323725 A1 | 12/2013 | Peter et al. |
| 2013/0330778 A1 | 12/2013 | Zeiner et al. |
| 2014/0011226 A1 | 1/2014 | Bernick et al. |
| 2014/0018441 A1 | 1/2014 | Fracchia et al. |
| 2014/0031240 A1 | 1/2014 | Behlke et al. |
| 2014/0038240 A1 | 2/2014 | Temme et al. |
| 2014/0106394 A1 | 4/2014 | Ko et al. |
| 2014/0141982 A1 | 5/2014 | Jacobson et al. |
| 2014/0170665 A1 | 6/2014 | Hiddessen et al. |
| 2014/0178992 A1 | 6/2014 | Nakashima et al. |
| 2014/0221250 A1 | 8/2014 | Vasquez et al. |
| 2014/0274729 A1 | 9/2014 | Kurn et al. |
| 2014/0274741 A1 | 9/2014 | Hunter et al. |
| 2014/0303000 A1 | 10/2014 | Armour et al. |
| 2014/0309119 A1 | 10/2014 | Jacobson et al. |
| 2014/0309142 A1 | 10/2014 | Tian |
| 2015/0010953 A1 | 1/2015 | Lindstrom et al. |
| 2015/0012723 A1 | 1/2015 | Park et al. |
| 2015/0031089 A1 | 1/2015 | Lindstrom |
| 2015/0038373 A1 | 2/2015 | Banyai et al. |
| 2015/0056609 A1 | 2/2015 | Daum et al. |
| 2015/0057625 A1 | 2/2015 | Coulthard |
| 2015/0065357 A1 | 3/2015 | Fox |
| 2015/0065393 A1 | 3/2015 | Jacobson |
| 2015/0099870 A1 | 4/2015 | Bennett et al. |
| 2015/0119293 A1 | 4/2015 | Short |
| 2015/0120265 A1 | 4/2015 | Amirav-Drory |
| 2015/0159152 A1 | 6/2015 | Allen et al. |
| 2015/0183853 A1 | 7/2015 | Sharma et al. |
| 2015/0191524 A1 | 7/2015 | Smith et al. |
| 2015/0191719 A1 | 7/2015 | Hudson et al. |
| 2015/0196917 A1 | 7/2015 | Kay et al. |
| 2015/0203839 A1 | 7/2015 | Jacobson et al. |
| 2015/0211047 A1 | 7/2015 | Borns |
| 2015/0225782 A1 | 8/2015 | Walder et al. |
| 2015/0240232 A1 | 8/2015 | Zamore et al. |
| 2015/0240280 A1 | 8/2015 | Gibson et al. |
| 2015/0261664 A1 | 9/2015 | Goldman et al. |
| 2015/0269313 A1 | 9/2015 | Church |
| 2015/0293102 A1 | 10/2015 | Shim |
| 2015/0307875 A1 | 10/2015 | Happe et al. |
| 2015/0321191 A1 | 11/2015 | Kendall et al. |
| 2015/0322504 A1 | 11/2015 | Lao et al. |
| 2015/0344927 A1 | 12/2015 | Sampson et al. |
| 2015/0353921 A9 | 12/2015 | Tian |
| 2015/0353994 A1 | 12/2015 | Myers et al. |
| 2015/0361420 A1 | 12/2015 | Hudson et al. |
| 2015/0361422 A1 | 12/2015 | Sampson et al. |
| 2015/0361423 A1 | 12/2015 | Sampson et al. |
| 2015/0368687 A1 | 12/2015 | Saaem et al. |
| 2015/0376602 A1 | 12/2015 | Jacobson et al. |
| 2016/0001247 A1 | 1/2016 | Oleinikov |
| 2016/0002621 A1 | 1/2016 | Nelson et al. |
| 2016/0002622 A1 | 1/2016 | Nelson et al. |
| 2016/0010045 A1 | 1/2016 | Cohen et al. |
| 2016/0017394 A1 | 1/2016 | Liang et al. |
| 2016/0017425 A1 | 1/2016 | Ruvolo et al. |
| 2016/0019341 A1 | 1/2016 | Harris et al. |
| 2016/0024138 A1 | 1/2016 | Gebeyehu et al. |
| 2016/0024576 A1 | 1/2016 | Chee et al. |
| 2016/0026753 A1 | 1/2016 | Krishnaswami et al. |
| 2016/0026758 A1 | 1/2016 | Jabara et al. |
| 2016/0032396 A1 | 2/2016 | Diehn et al. |
| 2016/0046973 A1 | 2/2016 | Efcavitch et al. |
| 2016/0046974 A1 | 2/2016 | Efcavitch et al. |
| 2016/0082472 A1 | 3/2016 | Perego et al. |
| 2016/0089651 A1 | 3/2016 | Banyai |
| 2016/0090422 A1 | 3/2016 | Reif et al. |
| 2016/0090592 A1 | 3/2016 | Banyai et al. |
| 2016/0096160 A1 | 4/2016 | Banyai et al. |
| 2016/0097051 A1 | 4/2016 | Jacobson et al. |
| 2016/0102322 A1 | 4/2016 | Ravinder et al. |
| 2016/0108466 A1 | 4/2016 | Nazarenko et al. |
| 2016/0122755 A1 | 5/2016 | Hall et al. |
| 2016/0122800 A1 | 5/2016 | Bernick et al. |
| 2016/0152972 A1 | 6/2016 | Stapleton et al. |
| 2016/0168611 A1 | 6/2016 | Efcavitch et al. |
| 2016/0184788 A1 | 6/2016 | Hall et al. |
| 2016/0200759 A1 | 7/2016 | Srivastava et al. |
| 2016/0215283 A1 | 7/2016 | Braman et al. |
| 2016/0229884 A1 | 8/2016 | Indermuhle |
| 2016/0230175 A1 | 8/2016 | Carstens |
| 2016/0230221 A1 | 8/2016 | Bergmann et al. |
| 2016/0251651 A1 | 9/2016 | Banyai |
| 2016/0253890 A1 | 9/2016 | Rabinowitz et al. |
| 2016/0256846 A1 | 9/2016 | Smith et al. |
| 2016/0264958 A1 | 9/2016 | Toro et al. |
| 2016/0289758 A1 | 10/2016 | Akeson et al. |
| 2016/0289839 A1 | 10/2016 | Harumoto et al. |
| 2016/0303535 A1 | 10/2016 | Banyai et al. |
| 2016/0304862 A1 | 10/2016 | Igawa et al. |
| 2016/0304946 A1 | 10/2016 | Betts et al. |
| 2016/0310426 A1 | 10/2016 | Wu |
| 2016/0310927 A1 | 10/2016 | Banyai et al. |
| 2016/0318016 A1 | 11/2016 | Hou et al. |
| 2016/0333340 A1 | 11/2016 | Wu |
| 2016/0339409 A1 | 11/2016 | Banyai |
| 2016/0340672 A1 | 11/2016 | Banyai et al. |
| 2016/0348098 A1 | 12/2016 | Stuelpnagel et al. |
| 2016/0354752 A1 | 12/2016 | Banyai et al. |
| 2016/0355880 A1 | 12/2016 | Gormley et al. |
| 2017/0017436 A1 | 1/2017 | Church |
| 2017/0066844 A1 | 3/2017 | Glanville |
| 2017/0067099 A1 | 3/2017 | Zheng et al. |
| 2017/0073664 A1 | 3/2017 | McCafferty et al. |
| 2017/0073731 A1 | 3/2017 | Zheng et al. |
| 2017/0081660 A1 | 3/2017 | Cox |
| 2017/0081716 A1 | 3/2017 | Peck |
| 2017/0088887 A1 | 3/2017 | Makarov et al. |
| 2017/0095785 A1 | 4/2017 | Banyai |
| 2017/0096706 A1 | 4/2017 | Behlke et al. |
| 2017/0114404 A1 | 4/2017 | Behlke et al. |
| 2017/0141793 A1 | 5/2017 | Strauss et al. |
| 2017/0147748 A1 | 5/2017 | Staehler et al. |
| 2017/0151546 A1 | 6/2017 | Peck et al. |
| 2017/0159044 A1 | 6/2017 | Toro et al. |
| 2017/0175110 A1 | 6/2017 | Jacobson et al. |
| 2017/0218537 A1 | 8/2017 | Olivares |
| 2017/0233764 A1 | 8/2017 | Young et al. |
| 2017/0247473 A1 | 8/2017 | Short |
| 2017/0249345 A1 | 8/2017 | Malik et al. |
| 2017/0253644 A1 | 9/2017 | Steyaert et al. |
| 2017/0298432 A1 | 10/2017 | Holt |
| 2017/0320061 A1 | 11/2017 | Venter et al. |
| 2017/0327819 A1 | 11/2017 | Banyai |
| 2017/0355984 A1 | 12/2017 | Evans et al. |
| 2017/0357752 A1 | 12/2017 | Diggans |
| 2017/0362589 A1 | 12/2017 | Banyai |
| 2018/0029001 A1 | 2/2018 | Banyai et al. |
| 2018/0051278 A1 | 2/2018 | Cox et al. |
| 2018/0051280 A1 | 2/2018 | Gibson et al. |
| 2018/0068060 A1 | 3/2018 | Ceze et al. |
| 2018/0101487 A1 | 4/2018 | Peck |
| 2018/0104664 A1 | 4/2018 | Fernandez |
| 2018/0126355 A1 | 5/2018 | Peck |
| 2018/0142289 A1 | 5/2018 | Zeitoun |
| 2018/0171509 A1 | 6/2018 | Cox |
| 2018/0236425 A1 | 8/2018 | Banyai et al. |
| 2018/0253563 A1 | 9/2018 | Peck |
| 2018/0264428 A1 | 9/2018 | Banyai et al. |
| 2018/0273936 A1 | 9/2018 | Cox et al. |
| 2018/0282721 A1 | 10/2018 | Cox et al. |
| 2018/0291445 A1 | 10/2018 | Betts et al. |

(56) References Cited

U.S. PATENT DOCUMENTS

| | | |
|---|---|---|
| 2018/0312834 A1 | 11/2018 | Cox et al. |
| 2018/0326388 A1 | 11/2018 | Banyai et al. |
| 2018/0334712 A1 | 11/2018 | Singer et al. |
| 2018/0346585 A1 | 12/2018 | Zhang et al. |
| 2018/0355351 A1 | 12/2018 | Nugent et al. |
| 2019/0060345 A1 | 2/2019 | Harrison et al. |
| 2019/0083596 A1 | 3/2019 | Orentas et al. |
| 2019/0118154 A1 | 4/2019 | Marsh et al. |
| 2019/0224711 A1 | 7/2019 | Demeris, Jr. |
| 2019/0240636 A1 | 8/2019 | Peck et al. |
| 2019/0244109 A1 | 8/2019 | Bramlett et al. |
| 2019/0314783 A1 | 10/2019 | Banyai et al. |
| 2019/0318132 A1 | 10/2019 | Peck |
| 2019/0352635 A1 | 11/2019 | Toro et al. |
| 2019/0366293 A1 | 12/2019 | Banyai et al. |
| 2019/0366294 A1 | 12/2019 | Banyai et al. |
| 2020/0017907 A1 | 1/2020 | Zeitoun et al. |
| 2020/0102611 A1 | 4/2020 | Zeitoun et al. |
| 2020/0156037 A1 | 5/2020 | Banyai et al. |
| 2020/0181667 A1 | 6/2020 | Wu et al. |
| 2020/0222875 A1 | 7/2020 | Peck et al. |
| 2020/0283760 A1 | 9/2020 | Nugent et al. |
| 2020/0299322 A1 | 9/2020 | Indermuhle et al. |
| 2020/0299684 A1 | 9/2020 | Toro et al. |
| 2020/0308575 A1 | 10/2020 | Sato |
| 2020/0325235 A1 | 10/2020 | Tabibiazar et al. |
| 2020/0342143 A1 | 10/2020 | Peck |
| 2021/0002710 A1 | 1/2021 | Gantt et al. |
| 2021/0040476 A1 | 2/2021 | Cox et al. |
| 2021/0071168 A1 | 3/2021 | Nugent et al. |
| 2021/0102192 A1 | 4/2021 | Tabibiazar et al. |
| 2021/0102195 A1 | 4/2021 | Sato et al. |
| 2021/0102198 A1 | 4/2021 | Cox et al. |
| 2021/0115594 A1 | 4/2021 | Cox et al. |
| 2021/0129108 A1 | 5/2021 | Marsh et al. |
| 2021/0142182 A1 | 5/2021 | Bramlett et al. |
| 2021/0147830 A1 | 5/2021 | Liss |
| 2021/0170356 A1 | 6/2021 | Peck et al. |
| 2021/0179724 A1 | 6/2021 | Sato et al. |
| 2021/0207197 A1 | 7/2021 | Gantt et al. |
| 2021/0332078 A1 | 10/2021 | Wu |
| 2021/0348220 A1 | 11/2021 | Zeitoun et al. |
| 2021/0355194 A1 | 11/2021 | Sato et al. |

FOREIGN PATENT DOCUMENTS

| | | |
|---|---|---|
| CN | 1771336 A | 5/2006 |
| CN | 101277758 A | 10/2008 |
| CN | 102159726 A | 8/2011 |
| CN | 103907117 A | 7/2014 |
| CN | 104520864 A | 4/2015 |
| CN | 104562213 A | 4/2015 |
| CN | 104734848 A | 6/2015 |
| CN | 105637097 A | 6/2016 |
| DE | 10260805 A1 | 7/2004 |
| EP | 0090789 A1 | 10/1983 |
| EP | 0126621 B1 | 8/1990 |
| EP | 0753057 A1 | 1/1997 |
| EP | 1314783 A1 | 5/2003 |
| EP | 1363125 A2 | 11/2003 |
| EP | 1546387 A2 | 6/2005 |
| EP | 1153127 B1 | 7/2006 |
| EP | 1728860 A1 | 12/2006 |
| EP | 1072010 B1 | 4/2010 |
| EP | 2175021 A2 | 4/2010 |
| EP | 2330216 A1 | 6/2011 |
| EP | 1343802 B1 | 5/2012 |
| EP | 2504449 A1 | 10/2012 |
| EP | 2751729 A1 | 7/2014 |
| EP | 2872629 A1 | 5/2015 |
| EP | 2928500 A1 | 10/2015 |
| EP | 2971034 A1 | 1/2016 |
| EP | 3030682 A2 | 6/2016 |
| EP | 3044228 A4 | 4/2017 |
| EP | 2994509 B1 | 6/2017 |
| EP | 3204518 A1 | 8/2017 |
| JP | H07505530 A | 6/1995 |
| JP | 2001518086 A | 10/2001 |
| JP | 2002511276 A | 4/2002 |
| JP | 2002536977 A | 11/2002 |
| JP | 2002538790 A | 11/2002 |
| JP | 2006503586 A | 2/2006 |
| JP | 2006238724 A | 9/2006 |
| JP | 2008505642 A | 2/2008 |
| JP | 2008097189 A | 4/2008 |
| JP | 2008523786 A | 7/2008 |
| JP | 2008214343 A | 9/2008 |
| JP | 2009294195 A | 12/2009 |
| JP | 2016527313 A | 9/2016 |
| WO | WO-9015070 A1 | 12/1990 |
| WO | WO-9210092 A1 | 6/1992 |
| WO | WO-9210588 A1 | 6/1992 |
| WO | WO-9309668 A1 | 5/1993 |
| WO | WO-9320242 A1 | 10/1993 |
| WO | WO-9525116 A1 | 9/1995 |
| WO | WO-9526397 A1 | 10/1995 |
| WO | WO-9615861 A1 | 5/1996 |
| WO | WO-9710365 A1 | 3/1997 |
| WO | WO-9822541 A2 | 5/1998 |
| WO | WO-9841531 A2 | 9/1998 |
| WO | WO-9942813 A1 | 8/1999 |
| WO | WO-9953101 A1 | 10/1999 |
| WO | WO-0013017 A2 | 3/2000 |
| WO | WO-0018957 A1 | 4/2000 |
| WO | WO-0042559 A1 | 7/2000 |
| WO | WO-0042560 A2 | 7/2000 |
| WO | WO-0042561 A2 | 7/2000 |
| WO | WO-0049142 A1 | 8/2000 |
| WO | WO-0053617 A1 | 9/2000 |
| WO | WO-0156216 A2 | 8/2001 |
| WO | WO-0210443 A1 | 2/2002 |
| WO | WO-0156216 A3 | 3/2002 |
| WO | WO-0220537 A2 | 3/2002 |
| WO | WO-0224597 A2 | 3/2002 |
| WO | WO-0227638 A1 | 4/2002 |
| WO | WO-0233669 A1 | 4/2002 |
| WO | WO-02072791 A2 | 9/2002 |
| WO | WO-03040410 A1 | 5/2003 |
| WO | WO-03046223 A1 | 6/2003 |
| WO | WO-03054232 A2 | 7/2003 |
| WO | WO-03060084 A2 | 7/2003 |
| WO | WO-03064026 A1 | 8/2003 |
| WO | WO-03064027 A2 | 8/2003 |
| WO | WO-03064699 A2 | 8/2003 |
| WO | WO-03065038 A2 | 8/2003 |
| WO | WO-03066212 A2 | 8/2003 |
| WO | WO-03089605 A2 | 10/2003 |
| WO | WO-03093504 A1 | 11/2003 |
| WO | WO-03100012 A2 | 12/2003 |
| WO | WO-2004024886 A2 | 3/2004 |
| WO | WO-2004029220 A2 | 4/2004 |
| WO | WO-2004029586 A1 | 4/2004 |
| WO | WO-2004031351 A2 | 4/2004 |
| WO | WO-2004031399 A2 | 4/2004 |
| WO | WO-2004059556 A2 | 7/2004 |
| WO | WO-03060084 A3 | 8/2004 |
| WO | WO-2005014850 A2 | 2/2005 |
| WO | WO-2005051970 A2 | 6/2005 |
| WO | WO-2005059096 A2 | 6/2005 |
| WO | WO-2005059097 A2 | 6/2005 |
| WO | WO-2005093092 A2 | 10/2005 |
| WO | WO-2006023144 | 3/2006 |
| WO | WO-2006044956 A1 | 4/2006 |
| WO | WO-2006076679 A1 | 7/2006 |
| WO | WO-2006116476 A1 | 11/2006 |
| WO | WO-2007073171 A2 | 6/2007 |
| WO | WO-2007109221 A2 | 9/2007 |
| WO | WO-2007118214 A2 | 10/2007 |
| WO | WO-2007120627 A2 | 10/2007 |
| WO | WO-2007137242 A2 | 11/2007 |
| WO | WO-2008003116 A2 | 1/2008 |
| WO | WO-2008006078 A2 | 1/2008 |
| WO | WO-2008027558 A2 | 3/2008 |
| WO | WO-2008045380 | 4/2008 |

(56) References Cited

FOREIGN PATENT DOCUMENTS

| | | |
|---|---|---|
| WO | WO-2008054543 A2 | 5/2008 |
| WO | WO-2008063134 A1 | 5/2008 |
| WO | WO-2008063135 A1 | 5/2008 |
| WO | WO-2008068280 A1 | 6/2008 |
| WO | WO-2008103474 A1 | 8/2008 |
| WO | WO-2008109176 A2 | 9/2008 |
| WO | WO-2009132876 A1 | 11/2009 |
| WO | WO-2010001251 A2 | 1/2010 |
| WO | WO-2010025310 A2 | 3/2010 |
| WO | WO-2010025566 A1 | 3/2010 |
| WO | WO-2010027512 A2 | 3/2010 |
| WO | WO-2010089412 A1 | 8/2010 |
| WO | WO-2010141249 A2 | 12/2010 |
| WO | WO-2010141433 A2 | 12/2010 |
| WO | WO-2011020529 A2 | 2/2011 |
| WO | WO-2010141433 A3 | 4/2011 |
| WO | WO-2011053957 A2 | 5/2011 |
| WO | WO-2011056644 A2 | 5/2011 |
| WO | WO-2011056872 A2 | 5/2011 |
| WO | WO-2011066185 A1 | 6/2011 |
| WO | WO-2011066186 A1 | 6/2011 |
| WO | WO-2011085075 A2 | 7/2011 |
| WO | WO-2011103468 A2 | 8/2011 |
| WO | WO-2011109031 A1 | 9/2011 |
| WO | WO-2011143556 A1 | 11/2011 |
| WO | WO-2011150168 A1 | 12/2011 |
| WO | WO-2011161413 A2 | 12/2011 |
| WO | WO-2012013913 A1 | 2/2012 |
| WO | WO-2012061832 A1 | 5/2012 |
| WO | WO-2012078312 A2 | 6/2012 |
| WO | WO-2012149171 A1 | 11/2012 |
| WO | WO-2012154201 A1 | 11/2012 |
| WO | WO-2013010062 A2 | 1/2013 |
| WO | WO-2013030827 A1 | 3/2013 |
| WO | WO-2013032850 A2 | 3/2013 |
| WO | WO-2013036668 A1 | 3/2013 |
| WO | WO-2013049227 A2 | 4/2013 |
| WO | WO-2013101896 A1 | 7/2013 |
| WO | WO-2013134881 A1 | 9/2013 |
| WO | WO-2013154770 A1 | 10/2013 |
| WO | WO-2013170168 A1 | 11/2013 |
| WO | WO-2013177220 A1 | 11/2013 |
| WO | WO-2014004393 A1 | 1/2014 |
| WO | WO-2014008447 A1 | 1/2014 |
| WO | WO-2014021938 A1 | 2/2014 |
| WO | WO-2014035693 A2 | 3/2014 |
| WO | WO-2014088693 A1 | 6/2014 |
| WO | WO-2014089160 A1 | 6/2014 |
| WO | WO-2014093330 A1 | 6/2014 |
| WO | WO-2014093694 A1 | 6/2014 |
| WO | WO-2014151117 A1 | 9/2014 |
| WO | WO-2014151696 A1 | 9/2014 |
| WO | WO-2014160004 A1 | 10/2014 |
| WO | WO-2014160059 A1 | 10/2014 |
| WO | WO-2014206304 A1 | 12/2014 |
| WO | WO-2015017527 A2 | 2/2015 |
| WO | WO-2015021080 A2 | 2/2015 |
| WO | WO-2015021280 A1 | 2/2015 |
| WO | WO-2015031689 A1 | 3/2015 |
| WO | WO-2015040075 A1 | 3/2015 |
| WO | WO-2015054292 A1 | 4/2015 |
| WO | WO-2015066174 A1 | 5/2015 |
| WO | WO-2015081114 A2 | 6/2015 |
| WO | WO-2015081142 A1 | 6/2015 |
| WO | WO-2015081440 A1 | 6/2015 |
| WO | WO-2015090879 A1 | 6/2015 |
| WO | WO-2015095404 A2 | 6/2015 |
| WO | WO-2015120403 A1 | 8/2015 |
| WO | WO-2015136072 A1 | 9/2015 |
| WO | WO-2015160004 A1 | 10/2015 |
| WO | WO-2015175832 A1 | 11/2015 |
| WO | WO-2016007604 A1 | 1/2016 |
| WO | WO-2016011080 A2 | 1/2016 |
| WO | WO-2016022557 A1 | 2/2016 |
| WO | WO-2016053883 A1 | 4/2016 |
| WO | WO-2016055956 A1 | 4/2016 |
| WO | WO-2016065056 A1 | 4/2016 |
| WO | WO-2016126882 A1 | 8/2016 |
| WO | WO-2016126987 A1 | 8/2016 |
| WO | WO-2016130868 A2 | 8/2016 |
| WO | WO-2016161244 A2 | 10/2016 |
| WO | WO-2016162127 A1 | 10/2016 |
| WO | WO-2016164779 A1 | 10/2016 |
| WO | WO-2016172377 A1 | 10/2016 |
| WO | WO-2016173719 A1 | 11/2016 |
| WO | WO-2016183100 A1 | 11/2016 |
| WO | WO-2017049231 A1 | 3/2017 |
| WO | WO-2017053450 A1 | 3/2017 |
| WO | WO-2017059399 A1 | 4/2017 |
| WO | WO-2017095958 A1 | 6/2017 |
| WO | WO-2017100441 A1 | 6/2017 |
| WO | WO-2017118761 A1 | 7/2017 |
| WO | WO-2017158103 A1 | 9/2017 |
| WO | WO-2017214574 A1 | 12/2017 |
| WO | WO-2018026920 A1 | 2/2018 |
| WO | WO-2018038772 A1 | 3/2018 |
| WO | WO-2018057526 A2 | 3/2018 |
| WO | WO-2018094263 A1 | 5/2018 |
| WO | WO-2018112426 A1 | 6/2018 |
| WO | WO-2018119246 A1 | 6/2018 |
| WO | WO-2018156792 A1 | 8/2018 |
| WO | WO-2018170164 A1 | 9/2018 |
| WO | WO-2018170169 A1 | 9/2018 |
| WO | WO-2018170559 A1 | 9/2018 |
| WO | WO-2018200380 A1 | 11/2018 |
| WO | WO-2018231872 A1 | 12/2018 |
| WO | WO-2019014781 A1 | 1/2019 |
| WO | WO-2019051501 A1 | 3/2019 |
| WO | WO-2019079769 A1 | 4/2019 |
| WO | WO-2019084500 A1 | 5/2019 |
| WO | WO-2019136175 A1 | 7/2019 |
| WO | WO-2019222706 A1 | 11/2019 |
| WO | WO-2020139871 A1 | 7/2020 |
| WO | WO-2020176362 A1 | 9/2020 |
| WO | WO-2020176678 A1 | 9/2020 |
| WO | WO-2020176680 A1 | 9/2020 |
| WO | WO-2020257612 A1 | 12/2020 |
| WO | WO-2021119193 A2 | 6/2021 |

OTHER PUBLICATIONS

Alexeyev, Mikhail F. et al., "Gene synthesis, bacterial expression and purification of the Rickettsia prowazekii ATP/ADP translocase", Biochimica et Biophysics Acta, 1419:299-306, 1999.

Al-Housseiny et al., Control of interfacial instabilities using flow geometry Nature Physics, 8:747-750, 2012.

Amblard, Francois et al., "A magnetic manipulator for studying local rheology and micromechanical properties of biological systems", Rev. Sci. Instrum., 67(3):18-827, 1996.

Andoni and Indyk, Near-Optimal Hashing Algorithms for Approximate Nearest Neighbor in High Dimensions, Communications of the ACM, 51(1):117-122, 2008.

Arand et al. Structure of Rhodococcus erythropolis limonene-1,2-epoxide hydrolase reveals a novel active site. EMBO J. 22:2583-2592 (2003).

Arkles, et al. The Role of Polarity in the Structure of Silanes Employed in Surface Modification. Silanes and Other Coupling Agents. 5:51-64, 2009.

Arkles, Hydrophobicity, Hydrophilicity Reprinted with permission from the Oct. 2006 issue of Paint & Coatings Industry magazine, Retrieved on Mar. 19, 2016, 10 pages.

Assi et al. Massive-parallel adhesion and reactivity-measurements using simple and inexpensive magnetic tweezers. J. Appl. Phys. 92(9):5584-5586 (2002).

ATDBio, "Nucleic Acid Structure," Nucleic Acids Book, 9 pages, published on Jan. 22, 2005. from: http://www.atdbio.com/content/5/Nucleic-acid-structure.

ATDBio, "Solid-Phase Oligonucleotide Synthesis," Nucleic Acids Book, 20 pages, Published on Jul. 31, 2011. from: http://www.atdbio.com/content/17/Solid-phase-oligonucleotide-synthesis.

(56) References Cited

OTHER PUBLICATIONS

Au et al. Gene synthesis by a LCR-based approach: high level production of Leptin-L54 using synthetic gene in *Escherichia coli*. Biochemical and Biophysical Research Communications 248:200-203 (1998).
Baedeker, Mathias et al., Overexpression of a designed 2.2kb gene of eukaryotic phenylalanine ammonialyase in *Escherichia coli*•. FEBS Letters, 457:57-60, 1999.
Barbee, et al. Magnetic Assembly of High-Density DNA Arrays for Genomic Analyses. Anal Chem. 80(6):2149-2154, 2008.
Barton et al., A desk electrohydrodynamic jet printing system. Mechatronics, 20:611-616, 2010.
Beaucage, et al. Advances in the synthesis of oligonucleotides by the phosphoramidite approach. Tetrahedron. 48:2223-2311, 1992.
Beaucage, et al. Deoxynucleoside phosphoramidites—A new class of key intermediates for deoxypolynucleotide synthesis. Tetrahedron Lett. 22(20):1859-1862, 1981.
Beaucage, Serge L. et al., "The Chemical synthesis of DNA/RNA" Chapter 2 in: Encyclopedia of Cell Biology, 1:36-53, 2016.
Beaulieu, Martin et al., "PCR candidate region mismatch scanning adaptation to quantitative, high-throughput genotyping", Nucleic Acids Research, 29(5):1114-1124, 2001.
Beigelman, et al. Base-modified phosphoramidite analogs of pyrimidine ribonucleosides for RNA structure-activity studies. Methods Enzymol. 317:39-65, 2000.
Bethge et al., "Reverse synthesis and 3'-modification of RNA." Jan. 1, 2011, pp. 64-64, XP055353420. Retrieved from the Internet: URL:http://www.is3na.org/assets/events/Category%202-Medicinal%20Chemistry%20of%20 oligonucleotides%20%2864-108%29.pdf.
Binkowski et al., Correcting errors in synthetic DNA through consensus shuffling. Nucleic Acids Research, 33(6):e55, 8 pages, 2005.
Biswas, Indranil et al., "Identification and characterization of a thermostable MutS homolog from Thennus aquaticus", The Journal of Biological Chemistry, 271(9):5040-5048, 1996.
Biswas, Indranil et al., "Interaction of MutS protein with the major and minor grooves of a heteroduplex DNA", The Journal of Biological Chemistry, 272(20):13355-13364, 1997.
Bjornson, Keith P. et al., "Differential and simultaneous adenosine Di- and Triphosphate binding by MutS", The Journal of Biological Chemistry, 278(20):18557-18562, 2003.
Blanchard, et al. High-Density Oligonucleotide Arrays. Biosens. & Bioelectronics. 1996; 11:687-690.
Blanchard, et al., "High-Density Oligonucleotide Arrays," Biosensors & Bioelectronics, 11(6/7):687-690, 1996.
Blanchard, in: Genetic Engineering, Principles and Methods, vol. 20, Ed. J. Sedlow, New York: Plenum Press, p. 111-124, 1979.
Blawat et al., Forward error correction for DNA data storage. Procedia Computer Science, 80:1011-1022, 2016.
Bonini and Mondino, Adoptive T-cell therapy for cancer: The era of engineered T cells. European Journal of Immunology, 45:2457-2469, 2015.
Bornholt et al., A DNA-Based Archival Storage System, in International Conference on Architectural Support for Programming Languages and Operating Systems (ASPLOS), Apr. 2-6, 2016, Atlanta, GA, 2016, 637-649.
Borovkov et al., High-quality gene assembly directly from unpurified mixtures of microassay-synthesized oligonucleotides. Nucleic Acid Research, 38(19):e180, 10 pages, 2010.
Brunet, Aims and methods of biosteganography. Journal of Biotechnology, 226:56-64, 2016.
Buermans et al., "Next Generation sequencing technology: Advances and applications," Biochimica et Biophysica Acta (BBA)—Molecular Basis of Disease, 1842:1931-1941, 2014.
Butler, et al. In situ synthesis of oligonucleotide arrays by using surface tension. J Am Chem Soc. 123(37):8887-94, 2001.
Calvert, Lithographically patterned self-assembled films. In: Organic Thin Films and Surfaces: Directions for the Nineties, vol. 20, p. 109, ed. by Abraham Ulman, San Diego: Academic Press, 1995.

Cardelli, Two-Domain DNA Strand Displacement, Electron. Proc. Theor. Comput. Sci., 26:47-61,2010.
Carlson, "Time for New DNA Synthesis and Sequencing Cost Curves," 2014. [Online], Available: http://www.synthesis.cc/synthesis/2014/02/time_for_new_cost_curves_2014. 10 pages.
Carr, et al. Protein-mediated error correction for de novo DNA synthesis. Nucleic Acids Res. 32(20):e162, 9 pages, 2004.
Carter and Friedman, DNA synthesis and Biosecurity: Lessons learned and options for the future. J. Craig Venter Institute, La Jolla, CA, 28 pages, Oct. 2015.
Caruthers, Chemical synthesis of deoxyoligonucleotides by the phosphoramidite method. In Methods in Enzymology, Chapter 15, 154:287-313, 1987.
Caruthers. Gene synthesis machines: DNA chemistry and its uses. Science 230(4723):281-285 (1985).
Caruthers, The Chemical Synthesis of DNA/RNA: Our Gift to Science. J. Biol. Chem., 288(2):1420-1427, 2013.
Casmiro, Danilo R. et al., "PCR-based gene synthesis and protein NMR spectroscopy", Structure, 5(11):1407-1412, 1997.
CeGaT. Tech Note available at https://www.cegat.de/web/wp-content/uploads/2018/06/Twist-Exome-Tech-Note.pdf (4 pgs.) (2018).
Cello, et al. Chemical synthesis of poliovirus cDNA: generation of infectious virus in the absence of natural template. Science. 297(5583):1016-8, 2000.
Chalmers, et al. Scaling up the ligase chain reaction-based approach to gene synthesis. Biotechniques. 30(2):249-52, 2001.
Chan, et al. Natural and engineered nicking endonucleases—from cleavage mechanism to engineering of strand-specificity. Nucleic Acids Res. 39(1):1-18, 2011.
Chen, et al. Chemical modification of gene silencing oligonucleotides fordrug discovery and development. Drug Discov Today. 10(8):587-93 2005.
Chen et al., Programmable chemical controllers made from DNA, Nat. Nanotechnol., 8(10):755-762, 2013.
Cheng, et al. High throughput parallel synthesis of oligonucleotides with 1536 channel synthesizer. Nucleic Acids Res. 30(18):e93, 2002.
Chilamakuri et al. Performance comparison of fourexome capture systems for deep sequencing. BMC Genomics 15(1):449 (2014).
Chinese Patent Application No. 201280053850.7 First Office Action dated Jan. 29, 2016.
Chinese Patent Application No. 201280053850.7 Office Action dated Jun. 30, 2017.
Chinese Patent Application No. 201280053850.7 Third Office Action dated Dec. 18, 2017.
"Chinese Patent Application No. 201502398916 First Office Action dated Jul. 30, 2015".
Cho, et al. Capillary passive valve in microfluidic systems. NSTI-Nanotech. 2004; 1:263-266.
Chrisey et al., Fabrication of patterned DNA surfaces Nucleic Acids Research, 24(15):3040-3047 (1996).
Chung et al., One-step preparation of competent*Escherichia coli*:Transformation and storage of bacterial cells in the same solution. Proc Natl Acad Sci U S A. Apr. 1989;86(7):2172-2175.
Church et al., Next-generation digital information storage in DNA. Science, 337:6102, 1628-1629, 2012.
Cleary et al. Production of complex nucleic acid libraries using highly parallel in situ oligonucleotide synthesis. Nat Methods 1(3):241-248 (2004).
Cleary et al. Production of complex nucleic acid libraries using highly parallel in situ oligonucleotide synthesis. Nature Methods, 1(13):241-248, 2004.
Cohen et al., Human population: The next half century. Science, 302:1172-1175, 2003.
Crick. On protein synthesis. Symp Soc Exp Biol12:138-163,1958.
Cruse et al. Atlas of Immunology, Third Edition. Boca Raton:CRC Press (pp. 282-283) (2010).
Cutler, David J. et al., "High-throughput variation detection and genotyping using microarrays", Genome Research, vol. 11, 1913-19 (2001).
Dahl, et al. Circle-to-circle amplification for precise and sensitive DNA analysis. Proc Natl Acad Sci U S A. Mar. 30, 2004;101(13):4548-53. Epub Mar. 15, 2004.

(56) References Cited

OTHER PUBLICATIONS

De Mesmaeker, et al. Backbone modifications in oligonucleotides and peptide nucleic acid systems. Curr Opin Struct Biol. Jun. 1995;5(3):343-55.

De Silva et al. New Trends of Digital Data Storage in DNA. BioMed Res Int. 2016:8072463 (2016).

Deamer, David W. et al., "Characterization of nucleic acids by nanopore analysis", Ace. Cham. Res., vol. 35, No. 10, 817-825 (2002).

Deaven, The Human Genome Project: Recombinant clones for mapping and sequencing DNA. Los Alamos Science, 20:218-249, 1992.

Deng et al., Targeted bisulfite sequencing reveals changes in DNA methylation associated with nuclear reprogramming Nature Biotechnology, 27:352-360 (2009).

Dietrich, Rudiger.et al., "Gene assembly based on blunt-ended double-stranded DNA-modules", Biotechnology Techniques, vol. 12, No. 1, 49-54 (Jan. 1998).

Dillon et al. Exome sequencing has higher diagnostic yield compared to simulated diseasespecific panels in children with suspected monogenic disorders. Eur J Hum Genet 26(5):644-651 (2018).

Dormitzer et al., Synthetic generation of influenza vaccine viruses for rapid response to pandemics. Sci Translational Medicine, 5(185):185ra68, 14 pages, 2013.

Doudna et al. Genome editing. The new frontier of genome engineering with CRISPR-Cas9. Science 346(6213):1258096-1-1258096-9, 2014.

Dower et al., High efficiency transformation of *Eescherichia coli* by high voltage electroporation. Nucleic Acids Res. 16(13):6127-45 (1988).

Dressman, et al. Transforming single DNA molecules into fluorescent magnetic particles for detection and enumeration of genetic variations. Proc Natl Acad Sci USA. Jul. 22, 2003;100(15):8817-22. Epub Jul. 11, 2003.

Drmanac, et al. Human genome sequencing using unchained base reads on self-assembling DNA nanoarrays. Science. Jan. 1, 2010;327(5961):78-81. doi: 10.1126/science.1181498. Epub Nov. 5, 2009.

Droege and Hill, The Genome Sequencer FLXTM System-Longer reads, more applications, straight forward bioinformatics and more complete data sets Journal of Biotechnology, 136:3-10, 2008.

Duffy, et al. Rapid Prototyping of Microfluidic Systems in Poly(dimethylsiloxane). Anal Chem. Dec. 1, 1998;70(23):4974-84. doi: 10.1021/ac980656z.

Duggan, et al. Expression profiling using cDNA microarrays. Nat Genet. Jan. 1999;21(1 Suppl):10-4.

Dvorsky. Living Bacteria Can Now Store Data. GIZMODO internet publication. Retrieved from https://gizmodo.com/living-bacteria-can-now-store-data-1781773517 (4 pgs) (Jun. 10, 2016).

Eadie, et al. Guanine modification during chemical DNA synthesis. Nucleic Acids Res. Oct. 26, 1987;15(20):8333-49.

Eisen, Jonathan A., "A phylogenomic study of the MutS family of proteins", Nucleic Acids Research, vol. 26, No. 18, 4291-4300 (1998).

Ellis, et al. DNA assembly for synthetic biology: from parts to pathways and beyond. Integr Biol (Camb). Feb. 2011;3(2):109-18. doi: 10.1039/c0ib00070a. Epub Jan. 19, 2011.

El-Sagheer, et al. Biocompatible artificial DNA linker that is read through by DNA polymerases and is functional in *Escherichia coli*. Proc Natl Acad Sci USA. Jul. 12, 2011;108(28):11338-43. doi: 10.1073/pnas.1101519108. Epub Jun. 27, 2011.

Elsik et al., The Genome sequence of taurine cattle: A window of ruminant biology and evolution. Science, 324:522-529, 2009.

Elsner et al., 172 nm excimer VUV-triggered photodegradation and micropatterning of aminosilane films, Thin Solid Films, 517:6772-6776 (2009).

Engler, et al. A one pot, one step, precision cloning method with high throughput capability. PLoS One. 2008;3(11):e3647. doi: 10.1371/journal.pone.0003647. Epub Nov. 5, 2008.

Engler, et al. Golden gate shuffling: a one-pot DNA shuffling method based on type IIs restriction enzymes. PLoS One. 2009;4(5):e5553. doi: 10.1371/journal.pone.0005553. Epub May 14, 2009.

Erlich and Zielinski, DNA fountain enables a robust and efficient storage architecture. Science, 355(6328):950-054, 2017.

Eurasian Patent Application No. 201690081 Office Action dated Jun. 11, 2018.

European Patent Application No. 12827479.2 Extended European Search Report dated May 18, 2015.

European Patent Application No. 12827479.2 Partial European Search Report dated Jan. 29, 2015.

European Patent Application No. 14834665.3 Communication dated Jan. 16, 2018.

European Patent Application No. 14834665.3 extended European Search Report dated Apr. 28, 2017.

European Patent Application No. 14834665.3 Office Action dated May 2, 2018.

Evans et al., DNA Repair Enzymes. Current Protocols in Molecular Biology 84:III:3.9:3.9.1-3.9.12 http://www.ncbi.nlm.nih.gov/pubmed/18972391 (Published online Oct. 1, 2008 Abstract only provided).

Fahy, et al. Self-sustained sequence replication (3SR): an isothermal transcription-based amplification system alternative to PCR. PCR Methods Appl. Aug. 1991;1(1):25-33.

Fedoryak, Olesya D. et al., "Brominated hydroxyquinoline as a photolabile protecting group with sensitivity to multiphoton excitation", Org. Lett., vol. 4, No. 2, 3419-3422 (2002).

Ferretti et al., Total synthesis of a gene for bovine rhodopsin. PNAS, 83:599-603 (1986).

Finger et al., The wonders of Flap Endonucleases: Structure, function, mechanism and regulation. Subcell Biochem., 62:301-326, 2012.

Fodor, et al. Light-directed, spatially addressable parallel chemical synthesis. Science. Feb. 15, 1991;251(4995):767-73.

Fodor et al. Light-Directed, Spatially Addressable Parallel Chemical Synthesis. Science 251(4995):767-773 (1991).

Fogg et al., Structural basis for uracil recognition by archaeal family B Dna polymerases. Nature Structural Biology, 9(12):922-927, 2002.

Foldesi, et al. The synthesis of deuterionucleosides. Nucleosides Nucleotides Nucleic Acids. Oct.-Dec. 2000;19(10-12):1615-56.

Frandsen, et al. Efficient four fragment cloning for the construction of vectors for targeted gene replacement in filamentous fungi. BMC Molecular Biology 2008, 9:70.

Frandsen. Experimental setup. Dec. 7, 2010, 3 pages. http://www.rasmusfrandsen.dk/experimental_setup.htm.

Frandsen. The USER Friendly technology. USER cloning. Oct. 7, 2010, 2 pages. http://www.rasmusfrandsen.dk/user_cloning.htm.

Fullwood et al., Next-generation DNA sequencing of paired-end tags [PET] for transcriptome and genome analysis Genome Research, 19:521-532, 2009.

Galneder et al., Microelectrophoresis of a bilayer-coated silica bead in an optical trap: application to enzymology. Biophysical Journal, vol. 80, No. 5, 2298-2309 (May 2001).

Gao, et al. A flexible light-directed DNA chip synthesis gated by deprotection using solution photogenerated acids. Nucleic Acids Res. Nov. 15, 2001;29(22):4744-50.

Gao et al. A method for the generation of combinatorial antibody libraries using pIX phage display. PNAS 99(20):12612-12616 (2002).

Gao, et al. Thermodynamically balanced inside-out (TBIO) PCR-based gene synthesis: a novel method of primer design for high-fidelity assembly of longer gene sequences. Nucleic Acids Res. Nov. 15, 2003;31(22):e143.

Garaj, et al. Graphene as a subnanometre trans-electrode membrane. Nature. Sep. 9, 2010;467(7312):190-3. doi: 10.1038/nature09379.

Garbow, Norbert et al., "Optical tweezing electroghoresis of isolated, highly charged colloidal spheres", Colloids and Surfaces A: Physiochem. Eng. Aspects, vol. 195, 227-241 (2001).

GeneArt Seamless Cloning and Assembly Kits. Life Technologies Synthetic Biology. 8 pages, available online Jun. 15, 2012.

Genomics 101. An Introduction to the Genomic Workflow. 2016 edition, 64 pages. Available at: http://www.frontlinegenomics.com/magazine/6757/genomics-101/.

(56) References Cited

OTHER PUBLICATIONS

Geu-Flores, et al. USER fusion: a rapid and efficient method for simultaneous fusion and cloning of multiple PCR products. Nucleic Acids Res. 2007;35(7):e55. Epub Mar. 27, 2007.
Gibson Assembly. Product Listing. Application Overview. 2 pages, available online Dec. 16, 2014.
Gibson, et al. Complete chemical synthesis, assembly, and cloning of a Mycoplasma genitalium genome. Science. Feb. 29, 2008;319(5867):1215-20. doi: 10.1126/science.1151721. Epub Jan. 24, 2008.
Gibson et al. Creation of a Bacterial Cell Controlled by a Chemically Synthesized Genome. Science 329(5989):52-56 (2010).
Goldfeder et al. Medical implications of technical accuracy in genome sequencing. Genome Med 8(1):24(2016).
Goldman et al., Towards practical, high-capacity, low-maintenance information storage in synthesized DNA, Nature, 494(7435)77-80, 2013.
Gosse, Charlie et al. "Magnetic tweezers: micromanipulation and force measurement at the molecular level", Biophysical Journal, vol. 8, 3314-3329 (Jun. 2002).
Grass, et al., Robust chemical preservation of digital information on DNA in silica with errorcorrecting codes, Angew. Chemie—Int. Ed., 54(8):2552-2555, 2015.
Greagg et al., A read-ahead function in archaeal DNA polymerases detects promutagenic template-strand uracil. Proc. Nat. Acad. Sci. USA, 96:9045-9050, 1999.
Grovenor. Microelectronic materials. Graduate Student Series in Materials Science and Engineering. Bristol, England: Adam Hilger, 1989; p. 113-123.
Gu et al., Depletion of abundant sequences by hybridization (DASH): using Cas9 to remove unwanted high-abundance species in sequencing libraries and molecular counting applications. Genome Biology, 17:41, 13 pages, 2016.
Haber, Charbel et al., Magnetic tweezers for DNA micromanipulation, Rev. Sci. Instrum., vol. 71, No. 12, 4561-4570 (Dec. 2000).
Han et al. Linking T-cell receptor sequence to functional phenotype at the single-cell level. Nat Biotechnol 32(7):684-692 (2014).
Hanahan and Cold Spring Harbor Laboratory, Studies on transformation of *Escherichia coli* with plasmids J. Mol. Biol. 166:557-580 (1983).
Hanahan et al., Plasmid transformation of *Escherichia coli* and other bacteria. Methods Enzymol, vol. 204, p. 63-113 (1991).
Harada, et al. Unexpected substrate specificity of T4 DNA ligase revealed by in vitro selection. Nucleic Acids Res. May 25, 1993;21(10):2287-91.
Heckers Karl H. et al., "Error analysis of chemically synthesized polynucleotides", BioTechniques, vol. 24, No. 2, 256-260 (1998).
Herzer et al.: Fabrication of patterned silane based self-assembled monolayers by photolithography and surface reactions on silicon-oxide substrates Chem. Commun., 46:5634-5652 (2010).
Hoover et al., "DNAWorks: an automated method for designing oligonucleotides for PCR-based gene synthesis", Nucleic Acids Research, vol. 30, No. 10, e43, 7 pages (2002).
Hosu, Basarab G. et al., Magnetic tweezers for intracellular applications•, Rev. Sci. Instrum., vol. 74, No. 9, 4158-4163 (Sep. 2003).
Huang, Hayden et al., "Three-dimensional cellular deformation analysis with a two-photon magnetic manipulator workstation", Biophysical Journal, vol. 8 2, No. 4, 2211-2223 (Apr. 2002).
Hughes, et al. Expression profiling using microarrays fabricated by an ink-jet oligonucleotide synthesizer. Nat Biotechnol. Apr. 2001;19(4):342-7.
Hughes et al. Principles of early drug discovery. Br J Pharmacol 162(2):1239-1249, 2011.
Hutchison, et al. Cell-free cloning using phi29 DNA polymerase. Proc Natl Acad Sci USA. Nov. 29, 2005;102(48):17332-6. Epub Nov. 14, 2005.
IMGUR: The magic of the internet. Uploaded May 10, 2012, 2 pages, retrieved from: https://imgur.com/mEWuW.
In-Fusion Cloning: Accuracy, Not Background. Cloning & Competent Cells, ClonTech Laboratories, 3 pages, available online Jul. 6, 2014.
Jackson, Brian A. et al., "Recognition of DNA base mismatches by a rhodium intercalator", J. Am. Chem. Soc., vol. 19, 12986-12987 (1997).
Jacobs et al. DNA glycosylases: In DNA repair and beyond. Chromosoma 121:1-20 (2012)—http://www.ncbi.nlm.nih.gov/pmc/articles/PMC3260424/.
Jacobus et al. Optimal cloning of PCR fragments by homologous recombination in *Escherichia coli*. PLoS One 10(3):e0119221 (2015).
Jager et al. Simultaneous Humoral and Cellular: Immune Response against Cancer—Testis Antigen NY-ESO-1: Definition of Human Histocompatibility LeukocyteAntigen (HLA)-A2—binding Peptide Epitopes. J. Exp. Med. 187(2):265-270 (1998).
Jinek et al., A Programmable dual-RNA-guided DNA endonuclease in adaptive bacterial immunity. Science, 337:816-821, 2012.
Karagiannis and Ei-Osta, RNA interference and potential therapeutic applications of short interfering RNAs Cancer Gene Therapy, 12:787-795, 2005.
Ke, Song-Hua et al., "Influence of neighboring base pairs on the stability of single base bulges and base pairs in a DNA fragment", Biochemistry, Vo. 34, 4593-4600 (1995).
Kelley, Shana, et al. Single-base mismatch detection based on charge transduction through DNA, Nucleic Acids Research, vol. 27, No. 24, 4830-4837 (1999).
Kim et al., High-resolution patterns of quantum dots formed by electrohydrodynamic jet printing for light-emitting diodes. Nano Letters, 15:969-973, 2015.
Kim, Yang-Gyun et al., "Chimeric restriction endonuclease", Proc. Natl. Acad. Sci. USA, vol. 91, 883-887 (Feb. 1994).
Kim, Yang-Gyun, "The interaction between Z-ONA and the Zab domain of double-stranded RNA adenosine deaminase characterized using fusion nucleases", The Journal of Biological Chemistry, vol. 274, No. 27, 19081-19086 (1999).
Kim, Yan-Gyun et al., "Site specific cleavage of DNA-RNA hybrids by zinc finger/Fok I cleavage domain fusions" Gene, vol. 203, 43-49 (1997).
Kinde, et al. Detection and quantification of rare mutations with massively parallel sequencing. Proc Natl Acad Sci U S A. Jun. 7, 2011;108(23):9530-5. Epub May 17, 2011.
Kodumal, et al. Total synthesis of long DNA sequences: synthesis of a contiguous 32-kb polyketide synthase gene cluster. Proc Natl Acad Sci USA. Nov. 2, 2004;101(44):15573-8. Epub Oct. 20, 2004.
Koike-Yusa et al., Genome-wide recessive genetic screening in mammalian cells with a lentiviral CRISPR-guide RNA library. Nature Biotechnology, 32:267-273, 2014 (with three pages of supplemental "Online Methods").
Kong et al., Parallel gene synthesis in a microfluidic device. Nucleic Acids Res., 35(8):e61 (2007).
Kong. Microfluidic Gene Synthesis. MIT Thesis. Submitted to the program in Media Arts and Sciences, School of Architecture and Planning, in partial fulfillment of the requirements for the degree of Doctor of Philosophy in Media Arts and Sciences at the Massachusetts Institute of Technology. 143 pages Jun. 2008.
Kopp, Martin U. et al., "Chemical amplification: continuous-flow PCR on a chip", Science, vol. 280, 1046-1048 (May 15, 1998).
Kosuri and Church, "Large-scale de novo DNA synthesis: technologies and applications," Nature Methods, 11:499-507, 2014. Available at: http://www.nature.com/nmeth/journal/v11/n5/full/nmeth.2918.html.
Kosuri, et al. A scalable gene synthesis by selective amplification of DNA pools from high-fidelity microchips. Nature Biotechnology. 2010; 28:1295-1299.
Kosuri et al., A scalable gene synthesis platform using high-fidelity DNA microchips Nat.Biotechnol., 28(12):1295-1299, 2010.
Kosuri, S., et al., "Scalable gene synthesis by selective amplification of DNA pools from high-fidelity microchips," Nat Biotechnol. 28(12):1295-1299, 2010.
Krayden, Inc., A Guide to Silane Solutions. Silane coupling agents. 7 pages. Published on May 31, 2005 at: http://krayden.com/pdf/xia_silane_chemistry.pdf.

(56) References Cited

OTHER PUBLICATIONS

Lagally, et al. Single-Molecule DNA Amplification and Analysis in an Integrated Microfluidic Device. Analytical Chemistry. 2001;73(3): 565-570.
Lahue, R.S. et al., "DNA mismatch correction in a defined system", Science, vol. 425; No. 4914, 160-164 (Jul. 14, 1989).
Lambrinakos, A. et al., "Reactivity of potassium permanganate and tetraethylammonium chloride with mismatched bases and a simple mutation detection protocol",Nucleic Acids Research, vol. 27, No. 8, 1866-1874 (1999).
Landegren, et al. A ligase-mediated gene detection technique. Science. Aug. 26, 1988;241(4869):1077-80.
Lang, Matthew J. et al., "An automated two-dimensional optical force clamp for single molecule studies", Biophysical Journal, vol. 83, 491 501 (Jul. 2002).
Lashkari, et al. An automated multiplex oligonucleotide synthesizer: development of high-throughput, low-cost DNA synthesis. Proc Natl Acad Sci U S A. Aug. 15, 1995;92(17):7912-5.
Lausted et al., "POSaM: a fast, flexible, open-source, inkjet oligonucleotide synthesizer and microarrayer," Genome Biology, 5:R58, 17 pages, 2004. available at https://www.ncbi.nlm.nih.gov/pmc/articles/PMC507883/.
Leamon, et al. A massively parallel PicoTiterPlate based platform for discrete picoliter-scale polymerase chain reactions. Electrophoresis. Nov. 2003;24(21):3769-77.
Lee, Covalent end-immobilization of oligonucleotides onto solid surfaces. Thesis submitted to the Department of Chemical Engineering in Partial Fulfillment of the Requirements for the Degree of Doctor of Philosophy in Chemical Engineering at the Massachusetts Institute of Technology. Aug. 2001, 315 pages.
Lee, C.S. et al., "Microelectromagnets for the control of magnetic nanoparticles", Appl. Phys. Lett., vol. 79, No. 20, 3308-3310 (Nov. 12, 2001).
Lee, et al. A microfluidic oligonucleotide synthesizer. Nucleic Acids Research 2010 vol. 38(8):2514-2521. DOI: 10.1093/nar/gkq092.
Leproust, et al. Agilent's Microarray Platform: How High-Fidelity DNA Synthesis Maximizes the Dynamic Range of Gene Expression Measurements. 2008; 1-12. http://www.miltenyibiotec.com/~/media/Files/Navigation/Genomic%20Services/Agilent_DNA_Microarray_Platform.ashx.
Leproust, et al. Synthesis of high-quality libraries of long (150mer) oligonucleotides by a novel depurination controlled process. Nucleic Acids Research. 2010; 38(8):2522-2540.
Leproust et al., "Synthesis of high-quality libraries of long (150mer) oligonucleotides by a novel depurination controlled process," Nucleic Acids Research, 35(8):2522-2540, 2010.
Lesnikowski, et al. Nucleic acids and nucleosides containing carboranes. J. Organometallic Chem. 1999;581:156-169.
Leumann. DNA analogues: from supramolecular principles to biological properties. Bioorg Med Chem. Apr. 2002;10(4):841-54.
Levene, et al. Zero-mode waveguides for single-molecule analysis at high concentrations. Science. Jan. 31, 2003;299(5607):682-6.
Lewontin and Harti, Population genetics in forensic DNA typing. Science, 254:1745-1750, 1991.
Li et al., Beating bias in the directed evolution of proteins: Combining high-fidelity on-chip solid-phase gene synthesis with efficient gene assembly for combinatorial library construction. First published Nov. 24, 2017, 2 pages, retrieved from: https://doi.org/10.1002/cbic.201700540.
Li et al. Beating Bias in the Directed Evolution of Proteins: Combining High-Fidelity on-Chip Solid-Phase Gene Synthesis with Efficient Gene Assembly for Combinatorial Library Construction. ChemBioChem 19:221-228 (2018).
Light source unit for printable patterning VUV-Aligner / USHIO Inc., Link here: https://www.ushio.co.jp/en/products/1005.html, published Apr. 25, 2016, printed from the internet on Aug. 2, 2016, 3 pages.
Limbachiya et al., Natural data storage: A review on sending information from now to then via Nature. ACM Journal on Emerging Technologies in Computing Systems, V(N):Article A, May 19, 2015, 17 pages.
Link Technologies. "Product Guide 2010." Nov. 27, 2009, 136 pages. XP055353191. Retrieved from the Internet: URL:http://www.linktech.co.uk/documents/517/517.pdf.
Lipshutz, Robert J. et al., "High density synthetic oligonucleotide arrays", Nature Genetics Supplement, vol. 21, Jan. 20-24, 1999.
Lishanski, Alia et al., "Mutation detection by mismatch binding protein, MutS, in amplified DNA: application to the cystic fibrosis gene", Proc. Natl. Acad. Sci. USA, vol. 91, 2674-2678 (Mar. 1994).
Liu et al., Comparison of Next-Generation Sequencing Systems. Journal of Biomedicine and Biotechnology, 11 pages, 2012.
Liu, et al. Enhanced Signals and Fast Nucleic Acid Hybridization by Microfluidic Chaotic Mixing. Angew. Chem. Int. Ed. 2006; 45:3618-3623.
Liu et al., Rational design of CXCR4 specific antibodies with elongated CDRs. JACS, 136:10557-10560, 2014.
Lizardi, et al. Mutation detection and single-molecule counting using isothermal rolling-circle amplification. Nat Genet. Jul. 1998;19(3):225-32.
Li, Lin et al., "Functional domains in Fok I restriction endonuclease", Proc. Natl. Acad. Sci. USA, 89:4275-4279, 1992.
Lu, A.-Lien et al., "Methyl-directed repair of DNA base-pair mismatches in vitro", Proc. Natl. Acad. Sci. USA, 80:4639-4643, 1983.
Lund, et al. A validated system for ligation-free uracilexcision based assembly of expression vectors for mammalian cell engineering. DTU Systems of Biology. 2011. 1 page. http://www.lepublicsystemepco.com/files/modules/gestion_rubriques/REF-B036-Lund_Anne%20Mathilde.pdf.
Ma, et al. DNA synthesis, assembly and application in synthetic biology. Current Opinion in Chemical Biology. 16:260-267, 2012.
Ma et al., Versatile surface functionalization of cyclic olefin copolymer (COC) with sputtered SiO2 thin film for potential BioMEMS applications. Journal of Materials Chemistry, 11 pages, 2009.
Mahato et al., Modulation of gene expression by antisense and antigene oligodeoxynucleotides and small interfering RNA Expert Opin. Drug Delivery, 2(1):3-28, 2005.
Margulies, et al. Genome sequencing in open microfabricated high-density picolitre reactors. Nature. 437(7057):376-80, 2005.
Matteucci, et al. Synthesis of deoxyoligonucleotides on a polymer support. J. Am. Chem. Soc. 103(11):3185-3191, 1981.
Matzas et al., Next generation gene synthesis by targeted retrieval of bead-immobilized, sequence verified DNA clones from a high throughput pyrosequencing device. Nat. Biotechnol., 28(12):1291-1294, 2010.
McBride & Caruthers, "An investigation of several deoxynucleoside phosphoramidites useful for synthesizing deoxyoligonucleotides." Tetrahedron Lett. 24: 245-248, 1983.
McGall, et al. Light-directed synthesis of high-density oligonucleotide arrays using semiconductor photoresists. Proc Natl Acad Sci USA. 93(24):13555-60, 1996.
McGall, et al. The Efficiency of Light-Directed Synthesis of DNA Arrays on Glass Substrates. J. Am. Chem. Soc. 119(22):5081-5090, 1997.
Mei et al., Cell-free protein synthesis in microfluidic array devices Biotechnol. Prog., 23(6):1305-1311, 2007.
Mendel-Hartvig. Padlock probes and rolling circle amplification. New possibilities for sensitive gene detection. Comprehensive Summaries of Uppsala Dissertations from the Faculty of Medicine 1175. Uppsala University. 2002, 39 pages, http://www.diva-portal.org/smash/get/diva2:161926/FULLTEXT01.pdf.
Meyers and Friedland, Knowledge-based simulation of genetic regulation in bacteriophage lambda. Nucl. Acids Research, 12(1):1-16, 1984.
Meynert et al. Quantifying single nucleotide variant detection sensitivity in exome sequencing. BMC Bioinformatics 14:195 (2013).
Meynert et al. Variant detection sensitivity and biases in whole genome and exome sequencing. BMC Bioinformatics 15:247 (2014).

(56) References Cited

OTHER PUBLICATIONS

Milo and Phillips, Numbers here reflect the number of protein coding genes and excludes tRNA and non-coding RNA. Cell Biology by the Numbers p. 286, 2015.
Mitra, et al. In situ localized amplification and contact replication of many individual DNA molecules. Nucleic Acids Res. 27(24):e34, 1999.
Morin et al., Profiling the HeLa S3 transcriptome using randomly primed cDNA and massively parallel short-read sequencing. Biotechniques, 45:81-94, 2008.
Morris and Stauss, Optimizing T-cell receptor gene therapy for hematologic malignancies. Blood, 127(26):3305-3311, 2016.
Muller, Caroline et al. "Protection and labelling of thymidine by a fluorescent photolabile group", Helvetica Chimica Acta, vol. 84, 3735-3741 (2001).
Mulligan. Commercial Gene Synthesis Technology PowerPoint presentation. BlueHeron® Biotechnology. Apr. 5, 2006 (48 pgs).
Nakatani, Kazuhiko et al., "Recognition of a single guanine bulge by 2-Acylamino-1,8-naphthyridine", J. Am. Chem. Soc., vol. 122, 2172-2177 (2000).
Neiman M.S,. Negentropy principle in information processing systems. Radiotekhnika, 1966, No. 11, p. 2-9.
Neiman M.S., On the bases of the theory of information retrieval. Radiotekhnika, 1967, No. 5, p. 2-10.
Neiman M.S., On the molecular memory systems and the directed mutations. Radiotekhnika, 1965, No. 6, pp. 1-8.
Neiman M.S., On the relationships between the reliability, performance and degree of microminiaturization at the molecular-atomic level. Radiotekhnika, 1965, No. 1, pp. 1-9.
Neiman M.S., Some fundamental issues of microminiaturization. Radiotekhnika, 1964, No. 1, pp. 3-12.
Nishikura, A short primer on RNAi: RNA-directed RNA polymerase acts as a key catalyst Cell, 107:415-418, 2001.
Nour-Eldin, et al. USER Cloning and USER Fusion: The Ideal Cloning Techniques for Small and Big Laboratories. Plant Secondary Metabolism Engineering. Methods in Molecular Biology vol. 643, 2010, pp. 185-200.
Ochman, et al. Genetic applications of an inverse polymerase chain reaction. Genetics. Nov. 1988;120(3):621-3.
Organick et al., Random access in large-scale DNA data storage. Nature Biotechnology, Advance Online Publication, 8 pages, 2018.
Organick et al., Scaling up DNA data storage and random access retrieval, bioRxiv, preprint first posted online Mar. 7, 2017, 14 pages.
Pan, et al. An approach for global scanning of single nucleotide variations. Proc Natl Acad Sci U S A. Jul. 9, 2002;99(14):9346-51.
Pankiewicz. Fluorinated nucleosides. Carbohydr Res. Jul. 10, 2000;327(1-2):87-105.
PCT/IL2012/000326 International Preliminary Report on Patentability dated Dec. 5, 2013.
PCT/IL2012/000326 International Search Report dated Jan. 29, 2013.
PCT/US14/049834 International Preliminary Report on Patentability dated Feb. 18, 2016.
PCT/US2014/049834 International Search Report and Written Opinion dated Mar. 19, 2015.
PCT/US2014/049834, "Invitation to Pay Additional Fees and, where applicable, protest fee," mailed Jan. 5, 2015.
PCT/US2015/043605 International Preliminary Report on Patentability dated Feb. 16, 2017.
PCT/US2015/043605 International Search Report and Written Opinion dated Jan. 6, 2016.
PCT/US2015/043605 Invitation to Pay Additional Fees dated Oct. 28, 2015.
PCT/US2016/016459 International Preliminary Report on Patentability dated Aug. 17, 2017.
PCT/US2016/016459 International Search Report and Written Opinion dated Apr. 13, 2016.
PCT/US2016/016636 International Preliminary Report on Patentability dated Aug. 17, 2017.
PCT/US2016/016636 International Search Report and Written Opinion dated May 2, 2016.
PCT/US2016/028699 International Preliminary Report on Patentability dated Nov. 2, 2017.
PCT/US2016/028699 International Search Report and Written Opinion dated Jul. 29, 2016.
PCT/US2016/031674 International Preliminary Report on Patentability dated Nov. 23, 2017.
PCT/US2016/031674 International Search Report and Written Opinion dated Aug. 11, 2016.
PCT/US2016/052336 International Preliminary Report on Patentability dated Mar. 29, 2018.
PCT/US2016/052336 International Search Report and Written Opinion dated Dec. 7, 2016.
PCT/US2016/052916 International Preliminary Report on Patentability dated Apr. 5, 2018.
PCT/US2016/052916 International Search Report and Written Opinion dated Dec. 30, 2016.
PCT/US2016/064270 International Preliminary Report on Patentability dated Jun. 14, 2018.
PCT/US2016/064270 International Search Report and Written Opinion dated Apr. 28, 2017.
PCT/US2017/026232 International Search Report and Written Opinion dated Aug. 28, 2017.
PCT/US2017/036868 International Search Report and Written Opinion dated Aug. 11, 2017.
PCT/US2017/045105 International Search Report and Written Opinion dated Oct. 20, 2017.
PCT/US2017/052305 International Search Report and Written Opinion dated Feb. 2, 2018.
PCT/US2017/062391 International Search Report and Written Opinion dated Mar. 28, 2018.
PCT/US2017/066847 International Search Report and Written Opinion dated May 4, 2018.
PCT/US2018/022487 International Search Report and Written Opinion dated Aug. 1, 2018.
PCT/US2018/022493 International Search Report and Written Opinion dated Aug. 1, 2018.
PCT/US2018/037152 International Search Report and Written Opinion dated Aug. 28, 2018.
PCT/US2018/037161 Invitation to Pay Additional Fees dated Aug. 27, 2018.
PCT/US2018/056783 International Search Report and Written Opinion of the International Searching Authority dated Dec. 20, 2018.
PCT/US2018/19268 International Search Report and Written Opinion dated Jun. 26, 2018.
PCT/US2018/19268 Invitation to Pay Additional Fees and, where applicable, protest fee dated May 2, 2018.
PCT/US2018/22487 Invitation to Pay Additional Fees and, where applicable, protest fee dated May 31, 2018.
PCT/US2018/22493 Invitation to Pay Additional Fees and, where applicable, protest fee dated May 31, 2018.
Pease, et al. Light-generated oligonucleotide arrays for rapid DNA sequence analysis. Proc Natl Acad Sci U S A. May 24, 1994;91 (11):5022-6.
Peisajovich, et al. BBF RFC 28: A method for combinatorial multi-part assembly based on the type-lis restriction enzyme aarl. Sep. 16, 2009, 7 pages.
Pellois, et al. "Individually addressable parallel peptide synthesis on microchips", Nature Biotechnology, vol. 20, 922-926 (Sep. 2002).
Petersen, et al. LNA: a versatile tool for therapeutics and genomics. Trends Biotechnol. Feb. 2003;21(2):74-81.
Pierce and Wangh, Linear-after-the-exponential polymerase chain reaction and allied technologies Real-time detection strategies for rapid, reliable diagnosis from single cells Methods Mol. Med. 132:65-85 (2007) (Abstract only).
Pierce, et al. Linear-after-the-exponential polymerase chain reaction and allied technologies. Real-time detection strategies for rapid, reliable diagnosis from single cells. Methods Mol Med. 2007;132:65-85.
Pirrung. How to make a DNA chip. Angew. Chem. Int. Ed., 41:1276-1289, 2002.

(56) References Cited

OTHER PUBLICATIONS

Plesa et al., Multiplexed gene synthesis in emulsions for exploring protein functional landscapes. Science, 10.1126/science.aao5167, 10 pages, 2018.
Pon. Solid-phase supports for oligonucleotide synthesis. Methods Mol Biol. 1993;20:465-96.
Poster. Reimagine Genome Scale Research. 2016, 1 page. Available at http://www2.twistbioscience.com/Oligo_Pools_CRISPR_poster.
Powers et al. Optimal strategies for the chemical and enzymatic synthesis of bihelical deoxyribonucleic acids. J Am Chem Soc., 97(4):875-884, 1975.
Pray. "Discovery of DNA Structure and Function: Watson and Crick," Nature Education, 2008, 6 pages, available at: http://www.nature.com/scitable/topicpage/discovery-of-dna-structure-and-function-watson-397.
Prodromou, et al. Recursive PCR: a novel technique for total gene synthesis. Protein Eng. Dec. 1992;5(8):827-9.
Puigbo. Optimizer: a web server for optimizing the codon usage of DNA sequences. Nucleic Acid Research, 35(14):126-131, 2007.
Qian and Winfree, Scaling up digital circuit computation with DNA strand displacement cascades. Science, 332(6034):196-1201, 2011.
Qian, et al., Neural network computation with DNA strand displacement cascades, Nature, 475(7356):368-372, 2011.
Quan et al., "Parallel on-chip gene synthesis and application to optimization of protein expression," Nature Biotechnology, 29(5):449-452, 2011.
Rafalski and Morgante, Corn and humans: recombination and linkage disequilibrium in two genomes of similar size. Trends in Genetics, 20(2):103-111, 2004.
Raje and Murma, A Review of electrohydrodynamic-inkjet printing technology. International Journal of Emerging Technology and Advanced Engineering, 4(5):174-183, 2014.
Rastegari, et al., XNOR-Net: ImageNet Classification Using Binary Convolutional Neural Networks, in ECCV2016, Part IV, LNCS 9908, p. 525-542, 2016.
Reimagine SequenceSpace, Reimagine Research, Twist Bioscience, Product Brochure, Published Apr. 6, 2016 online at: www2.twistbioscience.com/TB_Product_Brochure_04.2016, 8 pages.
RF Electric discharge type excimer lamp. Products Catalog. Excimer lamp light source "flat excimer," 16 pages dated Jan. 2016. From: http://www.hamamatsu.com/jp/en/product/category/1001/3026/index.html.
Richmond, et al. Amplification and assembly of chip-eluted DNA (AACED): a method for high-throughput gene synthesis. Nucleic Acids Res. Sep. 24, 2004;32(17):5011-8. Print 2004.
Roche. Restriction Enzymes from Roche Applied Science—A Tradition of Premium Quality and Scientific Support. FAQS and Ordering Guide. Roche Applied Science. Accessed Jan. 12, 2015, 37 pages.
Rogozin et al., Origin and evolution of spliceosomal introns. Biology Direct, 7:11, 2012.
Ruminy, et al., "Long-range identification of hepatocyte nuclear factor-3 (FoxA) high and low-affinity binding Sites with a chimeric nuclease", J. Mol. Bioi., vol. 310, 523-535 (2001).
Saaem et al., In situ synthesis of DNA microarray on functionalized cyclic olefin copolymer substrate ACS Applied Materials & Interfaces, 2(2):491-497, 2010.
Saboulard, et al. High-throughput site-directed mutagenesis using oligonucleotides synthesized on DNA chips. Biotechniques. Sep. 2005;39(3):363-8.
Sacconi, L. et al., Three-dimensional magneto-optic trap for micro-object manipulation, Optics Letters, vol. 26, No. 17, 1359-1361 (Sep. 1, 2001).
Saiki et al. Analysis of enzymatically amplified beta-globin and HLA-DQ alpha DNA with allelespecific oligonucleotide probes. Nature 324:163-166 (1986).
Sandhu, et al. Dual asymmetric PCR: one-step construction of synthetic genes. Biotechniques. Jan. 1992;12(1):14-6.
Sargolzaei et al., Extent of linkage disequilibrium in Holstein cattle in North America. J.Dairy Science, 91:2106-2117, 2007.
Schaller, et al. Studies on Polynucleotides. XXV.1 The Stepwise Synthesis of Specific Deoxyribopolynucleotides (5). Further Studies on the Synthesis of Internucleotide Bond by the Carbodiimide Method. The Synthesis of Suitably Protected Dinucleotides as Intermediates in the Synthesis of Higher Oligonucleotides. J. Am. Chem. Soc. 1963; 85(23):3828-3835.
Schmalzing et al. Microchip electrophoresis: a method for high-speed SNP detection. Nucleic Acids Res 28(9):E43 (2000).
Schmii I et al., New strategies in engineering T-cell receptor gene-modified T cells to more effectively target malignancies. Clinical Cancer Research, 21(23):5191-5197, 2015.
Seelig, et al., Enzyme-Free Nucleic Acid Logic Circuits, Science 314(5805):1585-1588, 2006.
Sharan et al. Recombineering: a homologous recombination-based method of genetic engineering. Nat Profile 4(2):1-37 (originally pp. 206-223) (2009).
Sharpe and Mount, Genetically modified T cells in cancer therapy: opportunities and challenges. Disease Models and Mechanisms, 8:337-350, 2015.
Sierzchala, Agnieszka B. et al., "Solid-phase oligodeoxynucleotide synthesis : a two-step cycle using peroxy anion eprotection", J. Am. Chem. Soc., vol. 125, No. 44, 13427-13441 (2003).
Simonyan and Zisserman, Very Deep Convolutional Networks for Large-Scale Image Recognition, Published as a conference paper at Int. Conf. Learn. Represent., pp. 1-14, 2015.
Singh-Gasson, Sangeet et al., Maskless fabrication of light-directed olxyonucleotide microarrays using a digital micromirror array, Nature Biotechnology, vol. 17, 974-978 (Oct. 1999).
Skerra. Phosphorothioate primers improve the amplification of DNA sequences by DNA polymerases with proofreading activity. Nucleic Acids Res. Jul. 25, 1992; 20(14):3551-4.
Smith, et al. Generating a synthetic genome by whole genome assembly: phiX174 bacteriophage from synthetic oligonucleotides. Proc Natl Acad Sci USA. Dec. 23, 2003;100(26):15440-5. Epub Dec. 2, 2003.
Smith, et al. Generation of cohesive ends on PCR products by UDG-mediated excision of dU, and application for cloning into restriction digest-linearized vectors. PCR Methods Appl. May 1993;2(4):328-32.
Smith, Jane et al., "Mutation detection with MutH, MutL, and MutS mismatch repair proteins", Proc. Natl. Acad. Sci. USA, vol. 93, 4374-4379 (Apr. 1996).
Smith Jane et al., "Removal of Polymerase-Produced mutant sequences from PCR products", Proc. Natl. Acad. Sci. USA, vol. 94, 6847-6850 (Jun. 1997).
Smith, Steven B. et al., "Direct mechanical measurements of the elasticity of single DNA molecules using magnetic beads", Science, vol. 258, 1122-1126 (Nov. 13, 1992).
Soni, et al. Progress toward ultrafast DNA sequencing using solid-state nanopores. Clin Chem. Nov. 2007;53(11):1996-2001. Epub Sep. 21, 2007.
Southern, et al. Analyzing and comparing nucleic acid sequences by hybridization to arrays of oligonucleotides: evaluation using experimental models. Genomics. Aug. 1992;13(4):1008-17.
Sproat, et al. An efficient method for the isolation and purification of oligoribonucleotides. Nucleosides & Nucleotides. 1995; 14(1&2):255-273.
Srivannavit et al., Design and fabrication of microwell array chips for a solution-based, photogenerated acid-catalyzed parallel oligonuclotide DNA synthesis. Sensors and Actuators A, 116:150-160, 2004.
Srivastava et al., "RNA synthesis: phosphoramidites for RNA synthesis in the reverse direction. Highly efficient synthesis and application to convenient introduction of ligands, chromophores and modifications of synthetic RNA at the 3'-end", Nucleic Acids Symposium Series, 52(1):103-104, 2008.
Steel, The Flow-Thru Chip a Three-dimensional biochip platform. In: Schena, Microarray Biochip Technology, Chapter 5, Natick, MA: Eaton Publishing, 2000, 33 pages.
Stemmer, et al. Single-step assembly of a gene and entire plasmid from large numbers of oligodeoxyribonucleotides. Gene. Oct. 16, 1995;164(1):49-53.

(56) References Cited

OTHER PUBLICATIONS

Stryer. "DNA Probes and genes can be synthesized by automated solid-phase methods." Biochemstiry, 3rd edition, New York: W.H. Freeman and Company, 1998; 123-125.
Stutz, et al. Novel fluoride-labile nucleobase-protecting groups for the synthesis of 3'(2')-O-amino-acylated RNA sequences. Helv. Chim. Acta. 2000; 83(9):2477-2503.
Sullivan et al. Library construction and evaluation for site saturation mutagenesis. Enzyme Microb. Technol. 53:70-77 (2013).
Sun et al. Structure-Guided Triple-Code Saturation Mutagenesis: Efficient Tuning of the Stereoselectivity of an Epoxide Hydrolase. ACS Catal. 6:1590-1597 (2016).
Taiwanese Application No. 103126868 Office Action dated May 2, 2018.
Takahashi, Cell-free cloning using multiply-primed rolling circle amplification with modified RNA primers. Biotechniques. Jul. 2009;47(1):609-15. doi: 10.2144/000113155.
Tanase, M. et al., "Magnetic trapping of multicomponent nanowires", The Johns Hopkins University, Baltimore, Maryland, p. 1-3 (Jun. 25, 2001).
Taylor et al., Impact of surface chemistry and blocking strategies on DNA microarrays. Nucleic Acids Research, 31(16):e87, 19 pages, 2003.
The Hood Laboratory, "Beta Group." Assembly Manual for the POSaM: The ISB Piezoelelctric Oligonucleotide Synthesizer and Microarrayer, Inkjet Microarrayer Manual Version 1.2, 50 pages, May 28, 2004.
The SLIC, Gibson, CPEC and SLiCE assembly methods (and GeneArt Seamless, In-Fusion Cloning). 5 pages, available online Sep. 2, 2010.
Tian, et al. Accurate multiplex gene synthesis from programmable DNA microchips. Nature. Dec. 23, 2004;432(7020):1050-4.
Tsai et al., Dimeric CRISPR RNA-guided FokI nucleases for highly specific genome editing Nat. Biotechnol., 32(6):569-576, 2014.
Twist Bioscience | White Paper. DNA-Based Digital Storage. Retrieved from the internet, Twistbioscience.com, Mar. 27, 2018, 5 pages.
Unger, et al. Monolithic microfabricated valves and pumps by multilayer soft lithography. Science. Apr. 7, 2000;288(5463):113-6.
U.S. Appl. No. 14/241,874 Office Action dated Feb. 27, 2017.
U.S. Appl. No. 14/241,874 Office Action dated Jul. 14, 2016.
U.S. Appl. No. 14/241,874 Office Action dated May 4, 2018.
U.S. Appl. No. 14/452,429 Notice of Allowance dated Jun. 7, 2016.
U.S. Appl. No. 14/452,429 Office Action dated Oct. 21, 2015.
U.S. Appl. No. 14/452,429 Restriction Requirement dated Dec. 12, 2014.
U.S. Appl. No. 14/885,962 Notice of Allowance dated Nov. 8, 2017 and Sep. 29, 2017.
U.S. Appl. No. 14/885,962 Office Action dated Dec. 16, 2016.
U.S. Appl. No. 14/885,962 Office Action dated Sep. 8, 2016.
U.S. Appl. No. 14/885,962 Restriction Requirement dated Mar. 1, 2016.
U.S. Appl. No. 14/885,963 Notice of Allowance dated May 24, 2016.
U.S. Appl. No. 14/885,963 Office Action dated Feb. 5, 2016.
U.S. Appl. No. 14/885,965 Office Action dated Aug. 28, 2018.
U.S. Appl. No. 14/885,965 Office Action dated Aug. 30, 2017.
U.S. Appl. No. 14/885,965 Office Action dated Feb. 10, 2017.
U.S. Appl. No. 14/885,965 Office Action dated Feb. 18, 2016.
U.S. Appl. No. 14/885,965 Office Action dated Jan. 4, 2018.
U.S. Appl. No. 14/885,965 Office Action dated Jul. 7, 2016.
U.S. Appl. No. 15/135,434 Notice of Allowance dated Feb. 9, 2018.
U.S. Appl. No. 15/135,434 Office Action dated Nov. 30, 2017.
U.S. Appl. No. 15/135,434 Restriction Requirement dated Jul. 12, 2017.
U.S. Appl. No. 15/151,316 Office Action dated Jun. 7, 2018.
U.S. Appl. No. 15/154,879 Notice of Allowance dated Feb. 1, 2017.
U.S. Appl. No. 15/187,714 Restriction Requirement dated Sep. 17, 2018.
U.S. Appl. No. 15/187,721 Notice of Allowance dated Dec. 7, 2016.
U.S. Appl. No. 15/187,721 Office Action dated Oct. 14, 2016.
U.S. Appl. No. 15/233,835 Notice of Allowance dated Oct. 4, 2017.
U.S. Appl. No. 15/233,835 Office Action dated Feb. 8, 2017.
U.S. Appl. No. 15/233,835 Office Action dated Jul. 26, 2017.
U.S. Appl. No. 15/233,835 Restriction Requirement dated Nov. 4, 2016.
U.S. Appl. No. 15/245,054 Office Action dated Mar. 21, 2017.
U.S. Appl. No. 15/245,054 Office Action dated Oct. 19, 2016.
U.S. Appl. No. 15/268,422 Restriction Requirement dated Oct. 4, 2018.
U.S. Appl. No. 15/377,547 Office Action dated Jul. 27, 2018.
U.S. Appl. No. 15/377,547 Office Action dated Mar. 24, 2017.
U.S. Appl. No. 15/377,547 Office Action dated Nov. 30, 2017.
U.S. Appl. No. 15/433,909 Restriction Requirement dated Sep. 17, 2018.
U.S. Appl. No. 15/602,991 Notice of Allowance dated Oct. 25, 2017.
U.S. Appl. No. 15/602,991 Office Action dated May 31, 2018.
U.S. Appl. No. 15/602,991 Office Action dated Sep. 21, 2017.
U.S. Appl. No. 15/603,013 Office Action dated Jan. 30, 2018.
U.S. Appl. No. 15/603,013 Office Action dated Jul. 10, 2018.
U.S. Appl. No. 15/603,013 Office Action dated Oct. 20, 2017.
U.S. Appl. No. 15/682,100 Office Action dated Jan. 2, 2018.
U.S. Appl. No. 15/682,100 Restriction Requirement dated Nov. 8, 2017.
U.S. Appl. No. 15/729,564 Office Action dated Jan. 8, 2018.
U.S. Appl. No. 15/729,564 Office Action dated Jun. 6, 2018.
U.S. Appl. No. 15/860,445 Office Action dated May 30, 2018.
U.S. Appl. No. 14/452,429 Office Action dated Apr. 9, 2015.
Vaijayanthi, et al. Recent advances in oligonucleotide synthesis and their applications. Indian J Biochem Biophys. Dec. 2003;40(6):377-91.
Van Den Brulle, et al. A novel solid phase technology for high-throughput gene synthesis. Biotechniques. 2008; 45(3):340-343.
Van Der Werf et al. Limonene-1,2-epoxide hydrolase from Rhodococcus erythropolis DCL14 belongs to a novel class of epoxide hydrolases. J. Bacteriol. 180:5052-5057 (1998).
Van Tassell et al., SNP discovery and allele frequency estimation by deep sequencing of reduced representation libraries. Nature Methods, 5:247-252, 2008.
Vargeese, et al. Efficient activation of nucleoside phosphoramidites with 4,5-dicyanoimidazole during oligonucleotide synthesis. Nucleic Acids Res. Feb. 15, 1998;26(4):1046-50.
Verma et al. Modified oligonucleotides: synthesis and strategy for users. Annu Rev Biochem 67:99-134 (1998).
Vincent, et al. Helicase-dependent isothermal DNA amplification. EMBO Rep. Aug. 2004;5(8):795-800.
Visscher et al., "Construction of multiple-beam optical traps with nanometer-resolution position sensing", IEEE Journal of Selected Topics in Quantum Electronics, vol. 2, No. 4, 1066-1076 (Dec. 1996).
Voldmans Joel et al., "Holding forces of single-particle dielectrophoretic traps." Biophysical Journal, vol. 80, No. 1, 531-541 (Jan. 2001).
Vos, et al. AFLP:A new technique for DNA fingerprinting. Nucleic Acids Res. Nov. 11, 1995;23(21):4407-14.
Wagner et al., "Nucleotides, Part LXV, Synthesis of 2'-Deoxyribonucleoside 5'-Phosphoramidites: New Building Blocks for the Inverse (5'-3')-Oiigonucleotide Approach." Helvetica Chimica Acta, 83(8):2023-2035, 2000.
Wah, David A. et al., "Structure of Fok I has implications for DNA cleavage", Proc. Natl. Acad. Sci. USA, vol. 95, 10564-10569 (Sep. 1998).
Wah, David A. et al., "Structure of the multimodular endonuclease Fok I bound to DNA", Nature, vol. 388, 97-100 (Jul. 1997).
Walker, et al. Strand displacement amplification—an isothermal, in vitro DNA amplification technique. Nucleic Acids Res. Apr. 11, 1992;20(7):1691-6.
Wan et al., Deep Learning for Content-Based Image Retrieval: A comprehensive study, in Proceedings of the 22nd ACM International Conference on Multimedia—Nov. 3-7, 2014, Orlando, FL, p. 157-166, 2014.
Warr et al. Exome Sequencing: current and future perspectives. G3: (Bethesda) 5(8):1543-1550 (2015).

(56) References Cited

OTHER PUBLICATIONS

Weber, et al. A modular cloning system for standardized assembly of multigene constructs. PLoS One. Feb. 18, 2011;6(2):e16765. doi: 10.1371/journal.pone.0016765.
Welz, et al. 5-(Benzylmercapto)-1H-tetrazole as activator for 2'-O-TBDMS phosphoramidite building blocks in RNA synthesis. Tetrahedron Lett. 2002; 43(5):795-797.
Westin et al., Anchored multiplex amplification on a microelectronic chip array Nature Biotechnology, 18:199-202 (2000) (abstract only).
Whitehouse, Adrian et al. "Analysis of the mismatch and insertion/deletion binding properties of Thermus thermophilus, HB8, MutS", Biochemical and Biophysical Research Communications, vol. 233, 834-837 (1997).
Wiedenheft et al., RNA-guided genetic silencing systems in bacteria and archaea. Nature, 482:331-338, 2012.
Wijshoff, Herman. Structure and fluid-dynamics in Piezo inkjet printheads. Thesis. Venio, The Netherlands, published 2008, p. 1-185.
Wirtz, Denis, "Direct measurement of the transport properties of a single DNA molecule", Physical Review Letters, vol. 75, No. 12, 2436-2439 (Sep. 18, 1995).
Withers-Martinez, Chrislaine et al., "PCR-based gene synthesis as an efficient approach forexpression of the A+T-rich malaria genome", Protein Engineering, vol. 12, No. 12, 1113-1120 (1999).
Wood, Richard D. et al., "Human DNA repair genes", Science, vol. 291, 1284-1289 (Feb. 16, 2001).
Wosnick, et al. Rapid construction of large synthetic genes: total chemical synthesis of two different versions of the bovine prochymosin gene. Gene. 1987;60(1):115-27.
Wright and Church, An open-source oligomicroarray standard for human and mouse. Nature Biotechnology, 20:1082-1083, 2002.
Wu, et al. RNA-mediated gene assembly from DNA arrays. Angew Chem Int Ed Engl. May 7, 2012;51(19):4628-32. doi: 10.1002/anie.201109058.
Wu, et al. Specificity of the nick-closing activity of bacteriophage T4 DNA ligase. Gene. 1989;76(2):245-54.
Wu, Xing-Zheng et al., "An improvement of the on-line electrophoretic concentration method for capillary electrophoresis of proteins an experimental factors affecting he concentration effect", Analytical Sciences, vol. 16, 329-331 (Mar. 2000).
Xiong, et al. A simple, rapid, high-fidelity and cost-effective PCR-based two-step DNA synthesis method for long gene sequences. Nucleic Acids Res. 2004, 32(12):e98.
Xiong et al., Chemical gene synthesis: Strategies, softwares, error corrections, and applications. FEMS Microbiol. Rev., 32:522-540, 2008.
Xiong, et al. Non-polymerase-cycling-assembly-based chemical gene synthesis: Strategies, methods, and progress. Biotechnology Advances. 26(2):121-134, 2008.
Xu et al., Design of 240,000 orthogonal 25mer DNA barcode probes. PNAS, 106(7):2289-2294, 2009.
Yang, et al. "Purification, cloning, and characterization of the CEL I nuclease", Biochemistry, 39(13):3533-35, 2000.
Yazdi, et al., A Rewritable, Random-Access DNA-Based Storage System, Scientific Reports, 5, Article No. 14138, 27 pages, 2015.
Yehezkel et al., De novo DNA synthesis using single molecule PCR Nucleic Acids Research, 36(17):e107, 2008.
Yes HMDS vapor prime process application note Prepared by UC Berkeley and University of Texas at Dallas and re-printed by Yield Engineering Systems, Inc., 6 pages (http://www.yieldengineering.eom/Portals/0/HMDS%20Application%20Note.pdf (Published online Aug. 23, 2013).
Youil, Rima et al., "Detection of 81 of 81 known mouse Beta-Giobin promoter mutations with T4 Endonuclease VII• The EMC Method", Genomics, 32:431-435, 1996.
Young, et al. Two-step total gene synthesis method. Nucleic Acids Res. 32(7):e59, 2004.
Zhang and Seelig, Dynamic DNA nanotechnology using strand-displacement reactions, Nat. Chem., 3(2):103-113, 2011.

Zheleznaya, et al. Nicking endonucleases. Biochemistry (Mosc). 74(13):1457-66, 2009.
Zheng et al. Manipulating the Stereoselectivity of Limonene Epoxide Hydrolase by Directed Evolution Based on Iterative Saturation Mutagenesis. J. Am. Chem. Soc. 132:15744-15751 (2010).
Zhirnov et al., Nucleic acid memory. Nature Materials, 15:366, 2016.
Zhou et al., Microfluidic PicoArray synthesis of oligodeoxynucleotides and simultaneous assembling of multiple DNA sequences Nucleic Acids Research, 32(18):5409-5417, 2004.
Alberts et al.: Molecular Biology of the Cell. 4th edition. New York: Garland Science; 2002. The Generation of Antibody Diversity. https://www.ncbi.nlm.nih.gov/books/NBK26860/.
Almagro et al.: Progress and Challenges in the Design and Clinical Development of Antibodies for Cancer Therapy. Frontiers in immunology; 8, 1751 (2018) doi:10.3389/fimmu.2017.01751 https://www.frontiersin.org/articles/10.3389/fimmu.2017.01751/full.
Boodhansingh et al.: Novel Dominant K ATP Channel Mutations in Infants With Congenital Hyperinsulinism: Validation by in Vitro Expression Studies and in Vivo Carrier Phenotyping Am J Med Genet A.; 179(11):2214-2227 (2019).
Calabria et al.: GLP-1 receptor antagonist exendin-(9-39) elevates fasting blood glucose levels in congenital hyperinsulinism owing to inactivating mutations in the ATP-sensitive K+ channel. Diabetes. 61:2585-91 (2012).
Chee et al.: Population pharmacokinetics of exendin-(9-39) and clinical dose selection in patients with congenital hyperinsulinism. Br J Clin Pharmacol. 84(3):520-532 (2018).
Chervin et al.: Design of T-cell receptor libraries with diverse binding properties to examine adoptive T-cell responses. Gene Therapy. 20(6):634-644 (2012).
Craig et al.: Efficacy and pharmacokinetics of subcutaneous exendin (9-39) in patients with post-bariatric hypoglycaemia. Diabetes Obes Metab. 20:352-61 (2018).
Cyclodextrins used as excipients. Eur Med Agency Comm Hum Med Prod. Oct. 2017:16.
De León et al.: Exendin-(9-39) corrects fasting hypoglycemia in SUR-1-/- mice by lowering cAMP in pancreatic beta-cells and inhibiting insulin secretion. J Biol Chem. 283:25786-93 (2008).
De Leòn et al.: Role of Endogenous Glucagon-Like Peptide-1 in Islet Regeneration After Partial Pancreatectomy. Diabetes. 52:365-71 (2003).
DeWire et al.: β-Arrestins and Cell Signaling. Annual Review of Physiology. 69:483-510 (2007).
DeWitt et al.: A Public Database of Memory and Naive B-Cell Receptor Sequences. Research Article. PLoS One. | DOI:10.1371/journal.pone.0160853 (2016).
Eroshenko et al.: Gene Assembly from Chip-Synthesized Oligonucleotides; Current Protocols in Chemical biology 4: 1-17 (2012).
European Patent Application No. 16871446.7 First Official Action dated Nov. 13, 2019.
European Patent Application No. 17844060.8 Extended Search Report dated Apr. 20, 2020.
European Patent Application No. 17872347.4 Extended European Search Report dated Jun. 30, 2020.
European Patent Application No. 17881617.9 European Search Report and Written Opinion dated Jul. 2, 2020.
Galka et al.: QuickLib, a method for building fully synthetic plasmid libraries by seamless cloning of degenerate oligonucleotides. PLOS ONE, 12, e0175146:1-9 (2017).
Galka et al.: QuickLib, a method for building fully synthetic plasmid libraries by seamless cloning of degenerate oligonucleotides. PLOS ONE, 12, e0175146:S1 figure (2017).
Galka et al.: QuickLib, a method for building fully synthetic plasmid libraries by seamless cloning of degenerate oligonucleotides. PLOS ONE, 12, e0175146:S1 Table (2017).
Galka et al.: QuickLib, a method for building fully synthetic plasmid libraries by seamless cloning of degenerate oligonucleotides. PLOS ONE, 12, e0175146:S2 figure (2017).
Gilotra et al.: Efficacy of intravenous furosemide versus a novel, pH-neutral furosemide formulation administered subcutaneously in outpatients with worsening heart failure. JACC: Heart Failure, 6(1), pp. 65-70 (2017).

(56) References Cited

OTHER PUBLICATIONS

Göke et al.: Exendin-4 is a high potency agonist and truncated exendin-(9-39)-amide an antagonist at the glucagon-like peptide 1-(7-36)-amide receptor of insulin-secreting beta-cells. J Biol Chem. 268:19650-5 (1993).
Graven-Nielsen et al.: Quantification of local and referred muscle pain in humans after sequential in injections of hypertonic saline. Pain, 69(1-2), pp. 111-117 (1997).
Grigoriadis et al.: Drugability of Extracellular Targets: Discovery of Small Molecule Drugs Targeting Allosteric, Functional, and Subunit-Selective Sites on GPCRs and Ion Channels. Neuropsychopharmacology REVIEWS. 34: 106-125 (2009).
Hauser et al.: Trends in GPCR drug discovery: new agents, targets and indications. Nature Reviews Drug Discovery, 16, 829-842 (2017). doi:10.1038/nrd.2017.178 https://www.nature.com/articles/nrd.2017.178.
Heinemann et al.: U-100, pH-Neutral formulation of VIAject®: faster onset of action than insulin lispro in patients with type 1 diabetes. Diabetes, Obesity and Metabolism, 14(3), pp. 222-227 (2012).
http://www.bariatricnews.net/?q=tags/xoma-358.
Hötzel et al.: A strategy for risk mitigation of antibodies with fast clearance. mAbs, 4(6), 753-760 (2012). doi:10.4161/mabs.22189 https://www.ncbi.nlm.nih.gov/pubmed/23778268.
Hutchings CJ. A review of antibody-based therapeutics targeting G protein-coupled receptors: an update. Expert Opin Biol Ther. Apr 8:1-11 (2020).
Hutchings et al.: Opportunities for therapeutic antibodies directed at G-protein-coupled receptors. Nat Rev Drug Discov. 16(9):787-810 (2017).
International Application No. PCT/US2018/019268 International Preliminary Report on Patentability dated Sep. 6, 2019.
International Application No. PCT/US2019/032992 International Search Report and Written Opinion dated Oct. 28, 2019.
International Application No. PCT/US2019/032992 Invitation to Pay Additional Fees dated Sep. 6, 2019.
Larraufie et al.: Important Role of the GLP-1 Axis for Glucose Homeostasis after Bariatric Surgery. Cell Rep. 26(6):1399-1408.e6 (2019).
Lu et al.: Development of therapeutic antibodies for the treatment of diseases. Journal of Biomedical Science. 27:1 (2020).
Majima et al.: CGRP/CGRP Receptor Antibodies: Potential Adverse Effects Due to Blockade of Neovascularization? Trends in Pharmacological Sciences. 40(1):11-21 (2019).
Malecek et al.: Engineering improved T cell receptors using an alanine-scan guided T cell display selection system. Journal of Immunological Methods. Elsevier Science Publishers. 392(1):1-11 (2013).
Mathaes et al.: Subcutaneous injection volume of biopharmaceuticals—pushing the boundaries. Journal of pharmaceutical sciences, 105(8), pp. 2255-2259 (2016).
Meier et al.: Is the Diminished Incretin Effect in Type 2 Diabetes Just an Epi-Phenomenon of Impaired β-Cell Function? Diabetes. 59(5): 1117-1125 (2010).
Meier et al.: The potential role of glucagon-like peptide 1 in diabetes. Curr Opin Investig Drugs. 5:402-10 (2004).
Nauck et al.: Management of Endocrine Disease: Are all GLP-1 agonists equal in the treatment of type 2 diabetes? Eur J Endocrinol. 181(6):R211-R234 (2019).
Nixon et al.: Drugs derived from phage display: from candidate identification to clinical practice. MAbs 6:73-85 (2014).
Pan et al.: Everestmab, a novel long-acting GLP-1/anti GLP-1 R nanobody fusion protein, exerts potent anti-diabetic effects. Artificial Cells, Nanomedicine, and Biotechnology. 48(1):854-866 (2020).
Paul et al.: Acid binding and detritylation during oligonucleotide synthesis. Nucleic Acids Research. 15. pp. 3048-3052 (1996).
PCT/US2018/037152 International Preliminary Report on Patentability dated Dec. 26, 2019.
PCT/US2018/037161 International Preliminary Report on Patentability dated Dec. 17, 2019.
PCT/US2018/056783 International Preliminary Report on Patentability dated Apr. 30, 2020.
PCT/US2018/057857 International Preliminary Report on Patentability dated Apr. 28, 2020.
PCT/US2019/012218 International Preliminary Report on Patentability dated Jul. 16, 2020.
PCT/US2019/068435 International Search Report and Written Opinion dated Apr. 23, 2020.
PCT/US2020/019371 International Search Report and Written Opinion dated Jun. 25, 2020.
PCT/US2020/019986 Invitation to Pay Additional Fees dated Jun. 5, 2020.
PCT/US2020/019988 Invitation to Pay Additional Fees dated Jun. 8, 2020.
PubChem Data Sheet Acetonitrile. Printed from website https://pubchem.ncbi.nlm.nig.gov/ pp. 1-124 (2020).
PubChem Data Sheet Methylene Chloride. Printed from website https://pubchem.ncbi.nlm.nih.gov/ pp. 1-140 (2020).
Puskás et al.: Sulfobutylether-cyclodextrins: structure, degree of substitution and functional performance. In Cyclodextrins: Synthesis, Chemical Applications and Role in Drug Delivery (pp. 293-320). Nova Science Publishers, Hauppauge, NY (2015).
Rahman et al.: Molecular Mechanisms of Congenital Hyperinsulinism J Mol Endocrinol. 54(2):R119-29 (2015).
Rajpal et al.: A general method for greatly improving the affinity of antibodies by using combinatorial libraries. Proc. Natl. Acad. Sci. 102(24):8466-8471 (2005).
Rosenfeld et al.: Congenital hyperinsulinism disorders: Genetic and clinical characteristics. Am J Med Genet C Semin Med Genet. 181:682-92 (2019).
Seghers et al.: J. Sur1 Knockout Mice: A model for K Atp channel-independent regulation of insulin secretion. J Biol Chem. 275:9270-7 (2000).
Shimomura et al.: KATP Channel Mutations and Neonatal Diabetes. Intern Med. 56(18): 2387-2393 (2017).
Solomon et al.: Genomics at Agilent: Driving Value in DNA Sequencing. https://www.agilent.com/labs/features/2010_genomics.html, 8 pages (Aug. 5, 2010).
Song et al.: Human GLP-1 receptor transmembrane domain structure in complex with allosteric modulators. Nature 546:312-5 (2017).
Sriram et al.: G Protein-Coupled Receptors as Targets for Approved Drugs: How Many Targets and How Many Drugs? Insel Mol Pharmacol 93:251-258 (2018).
Thomas et al.: Mutation of the pancreatic islet inward rectifier Kir6.2 also leads to familial persistent hyperinsulinemic hypoglycemia of infancy. Hum Mol Genet. 5:1809-12 (1996).
Thomas et al.: Mutations in the sulfonylurea receptor gene in familial persistent hyperinsulinemic hypoglycemia of infancy. Science. 268:426-9 (1995).
Todd et al.: Incretins and other peptides in the treatment of diabetes. Diabet. Med. 24, 223-232 (2007).
Uccellatore et al.: Comparison Review of Short-Acting and Long-Acting Glucagon-like Peptide-1 Receptor Agonists. Diabetes Ther. 6:239-56 (2015).
U.S. Appl. No. 14/241,874 Final Office Action dated Jan. 28, 2019.
U.S. Appl. No. 15/015,059 Office Action dated Aug. 19, 2019.
U.S. Appl. No. 15/151,316 Final Office Action dated Jul. 9, 2020.
U.S. Appl. No. 15/151,316 Office Action dated Oct. 4, 2019.
U.S. Appl. No. 15/156,134 Final Office Action dated Jan. 3, 2020.
U.S. Appl. No. 15/187,714 Final Office Action dated Sep. 17, 2019.
U.S. Appl. No. 15/268,422 Final Office Action dated Oct. 3, 2019.
U.S. Appl. No. 15/272,004 Office Action dated Jun. 12, 2020.
U.S. Appl. No. 15/603,013 Final Office Action dated Nov. 6, 2019.
U.S. Appl. No. 15/619,322 Final Office Action dated Mar. 30, 2020.
U.S. Appl. No. 15/619,322 Office Action dated Aug. 14, 2019.
U.S. Appl. No. 15/816,995 Office Action dated May 19, 2020.
U.S. Appl. No. 15/816,995 Office Action dated Sep. 20, 2019.
U.S. Appl. No. 15/835,342 Office Action dated Dec. 2, 2019.
U.S. Appl. No. 15/835,342 Restriction Requirement dated Sep. 10, 2019.
U.S. Appl. No. 15/844,395 Office Action dated Jan. 24, 2020.
U.S. Appl. No. 15/921,479 Final Office Action dated Jun. 15, 2020.
U.S. Appl. No. 15/921,479 Office Action dated Nov. 12, 2019.

(56) References Cited

OTHER PUBLICATIONS

U.S. Appl. No. 15/960,319 Office Action dated Aug. 16, 2019.
U.S. Appl. No. 15/991,992 Office Action dated May 21, 2020.
U.S. Appl. No. 15/991,992 Restriction Requirement dated Mar. 10, 2020.
U.S. Appl. No. 16/006,581 Office Action dated Sep. 25, 2019.
U.S. Appl. No. 16/031,784 Office Action dated May 12, 2020.
U.S. Appl. No. 16/039,256 Restriction Requirement dated May 18, 2020.
U.S. Appl. No. 16/165,952 Office Action dated Mar. 12, 2020.
U.S. Appl. No. 16/239,453 Office Action dated May 11, 2020.
U.S. Appl. No. 16/239,453 Office Action dated Nov. 7, 2019.
U.S. Appl. No. 16/384,678 Office Action dated Jan. 21, 2020.
U.S. Appl. No. 16/409,608 Office Action dated Sep. 9, 2019.
U.S. Appl. No. 16/530,717 Final Office Action dated Apr. 15, 2020.
U.S. Appl. No. 16/530,717 Office Action dated Sep. 6, 2019.
U.S. Appl. No. 16/535,777 Office Action dated Jan. 23, 2020.
U.S. Appl. No. 16/535,779 First Action Interview dated Feb. 10, 2020.
U.S. Appl. No. 15/921,537 Office Action dated Apr. 1, 2020.
Vajravelu et al.: Genetic characteristics of patients with congenital hyperinsulinism. Curr Opin Pediatr. 30(4):568-575 (2018).
Wang, W.: Tolerability of hypertonic injectables. International journal of pharmaceutics, 490(1-2), pp. 308-315 (2015).
Yorifuji et al.: Congenital Hyperinsulinism: Current Status and Future Perspectives Ann Pediatr Endocrinol Metab. 19(2):57-68 (2014).
Zhang et al.: Rational Design of a Humanized Glucagon-Like Peptide-1 Receptor Agonist Antibody. Angew. Chem. Int. Ed.; 54:2126-2130 (2015).
Ai-Housseiny et al., Control of interfacial instabilities using flow geometry Nature Physics, 8:747-750, 2012.
Assembly manual for the POSaM: The ISB Piezoelelctric Oligonucleotide Synthesizer and Microarrayer, The Institute for Systems Biology, May 28, 2004 (50 pages).
ATDBio, Nucleic Acid Structure, Nucleic Acids Book, 9 pages, published on Jan. 22, 2005. from: http://www.atdbio.com/content/5/Nucleic-acid-structure.
Dower et al., High efficiency transformation of *Escherichia coli* by high voltage electroporation. Nucleic Acids Res. 16(13):6127-45 (1988).
Elsik et al., The Genome sequence of taurine cattle: A window of ruminant biology and evolution. Science, 324:522-528, 2009.
European Patent Application No. 14834665.3 Further Examination Report dated Nov. 28, 2018.
European Patent Application No. 16847497.1 Extended European Search Report dated Jan. 9, 2019.
European Patent Application No. 16871446.7 European Search Report dated Apr. 10, 2019.
Hughes et al. Expression profiling using microarrays fabricated by an ink-jet oligonucleotide synthesizer Nat Biotech 4:342-347 (2001).
International Application No. PCT/US2017/026232 International Preliminary Report on Patentability dated Feb. 26, 2019.
International Application No. PCT/US2017/045105 International Preliminary Report on Patentability dated Feb. 5, 2019.
International Application No. PCT/US2017/052305 International Preliminary Report on Patentability dated Apr. 30, 2019.
International Application No. PCT/US2017/062391 International Preliminary Report on Patentability dated May 21, 2019.
International Application No. PCT/US2018/050511 International Search Report and Written Opinion dated Jan. 11, 2019.
International Application No. PCT/US2018/057857 International Search Report and Written Opinion dated Mar. 18, 2019.
International Application No. PCT/US2019/012218 International Search Report and Written Opinion dated Mar. 21, 2019.
LEE: Covalent End-Immobilization of Oligonucleotides onto Solid Surfaces; Thesis, Massachusetts Institute of Technology, Aug. 2001 (315 pages).
Lipshutz, Robert J. et al., High density synthetic oligonucleotide arrays, Nature Genetics Supplement, vol. 21, 20-24 (Jan. 1999).
Mazor et al.: Isolation of Full-Length IgG Antibodies from Combinatorial Libraries Expressed in *Escherichia coli*; Antony S. Dimitrov (ed.), Therapeutic Antibodies: Methods and Protocols, vol. 525, Chapter 11, pp. 217-239 (2009).
Jo et al.: Engineering therapeutic antibodies targeting G-protein-coupled receptors; Experimental & Molecular Medicine; 48; 9 pages (2016).
Douthwaite et al.: Affinity maturation of a novel antagonistic human monoclonal antibody with a long VH CDR3 targeting the Class A GPCR formyl-peptide receptor 1; mAbs, vol. 7, Iss. 1, pp. 152-166 (Jan. 1, 2015).
PCT/US2014/049834 International Preliminary Report on Patentability dated Feb. 18, 2016.
PCT/US2018/037161 International Search Report and Written Opinion dated Oct. 22, 2018.
Schmitt et al., New strategies in engineering T-cell receptor gene-modified T cells to more effectively target malignancies. Clinical Cancer Research, 21(23):5191-5197, 2015.
Singh-Gasson, Sangeet et al., Maskless fabrication of light-directed oligonucleotide microarrays using a digital micromirror array, Nature Biotechnology, vol. 17, 974-978 (Oct. 1999).
Martinez-Torrecuadrada et al.: Targeting the Extracellular Domain of Fibroblast Growth Factor Receptor 3 with Human Single-Chain Fv Antibodies Inhibits Bladder Carcinoma Cell Line Proliferation; Clinical Cancer Research; vol. 11; pp. 6282-6290 (2005).
Sierzchala, Agnieszka B. et al., Solid-phase oligodeoxynucleotide synthesis : a two-step cycle using peroxy anion deprotection, J. Am. Chem. Soc., vol. 125, No. 44, 13427-13441 (2003).
U.S. Appl. No. 15/187,714 Office Action dated Apr. 4, 2019.
U.S. Appl. No. 15/603,013 Office Action dated Jun. 26, 2019.
Stryer. DNA Probes and genes can be synthesized by automated solid-phase methods. Biochemistry, 3rd edition, New York: W.H. Freeman and Company, 1988; 123-125.
The SLIC, Gibson, OPEC and SLiCE assembly methods (and GeneArt Seamless, In-Fusion Cloning). 5 pages, available online Sep. 2, 2010.
U.S. Appl. No. 15/015,059 Final Office Action dated Jul. 17, 2019.
U.S. Appl. No. 15/015,059 Office Action dated Feb. 7, 2019.
U.S. Appl. No. 15/156,134 Office Action dated Apr. 4, 2019.
U.S. Appl. No. 15/268,422 Office Action dated Mar. 1, 2019.
U.S. Appl. No. 15/377,547 Final Office Action dated Feb. 8, 2019.
U.S. Appl. No. 15/433,909 Non-Final Office Action dated Feb. 8, 2019.
U.S. Appl. No. 15/602,991 Final Office Action dated Dec. 13, 2018.
U.S. Appl. No. 15/602,991 Office Action dated May 31, 2019.
U.S. Appl. No. 15/709,274 Notice of Allowance dated Apr. 3, 2019.
U.S. Appl. No. 15/729,564 Final Office Action dated Dec. 13, 2018.
U.S. Appl. No. 15/729,564 Office Action dated May 30, 2019.
U.S. Appl. No. 15/816,995 Restriction Requirement dated Apr. 4, 2019.
U.S. Appl. No. 15/844,395 Restriction Requirement dated May 17, 2019.
U.S. Appl. No. 15/860,445 Final Office Action dated Dec. 13, 2018.
U.S. Appl. No. 15/921,479 Restriction Requirement dated May 24, 2019.
U.S. Appl. No. 15/151,316 Final Office Action dated Feb. 21, 2019.
Wagner et al., Nucleotides, Part LXV, Synthesis of 2'-Deoxyribonucleoside 5'-Phosphoramidites: New Building Blocks for the Inverse (5'-3')-Oligonucleotide Approach. Helvetica Chimica Acta, 83(8):2023-2035, 2000.
Wu, et al. Sequence-Specific Capture of Protein-DNA Complexes for Mass Spectrometric Protein Identification PLoS ONE. Oct. 20, 2011, vol. 6, No. 10.
Yes HMDS vapor prime process application note Prepared by UC Berkeley and University of Texas at Dallas and re-printed by Yield Engineering Systems, Inc., 6 pages (http://www.yieldengineering.com/Portals/0/HMDS%20Application%20Note.pdf (Published online Aug. 23, 2013).
Zheleznaya, et al. Nicking endonucleases. Biochemistry (Mose). 74(13):1457-66, 2009.

(56) References Cited

OTHER PUBLICATIONS

Zhou, et al. Establishment and application of a loop-mediated isothermal amplification (LAMP) system for detection of cry1Ac transgenic sugarcane Scientific Reports May 9, 2014, vol. 4, No. 4912.
Bai. A Novel Human scFv Library with Non-Combinatorial Synthetic CDR Diversity. PLoS One. 10(10):1-18 (2015).
Cui et al.: Information Security Technology Based on DNA Computing. International Workshop on Anti-Counterfeiting, Security and Identification (ASID); IEEE Xplore 4 pages (2007).
Geetha et al.: Survey on Security Mechanisms for Public Cloud Data. 2016 International Conference on Emerging Trends in Engineering, Technology and Science (ICETETS). 8 pages (2016).
Goodwin et al.: immunoglobulin heavy chain variable region, partial [Homo sapiens], Genbank entry (online). National Institute of Biotechnology Information. (2018) https://www.ncbi.nlm.nih.gov/protein/AXA12486.1.
Hopcroft et al.: What is the Young's Modulus of Silicon?. Journal of Microelectromechanical Systems. 19(2):229-238 (2010).
Jaiswal et al.: An architecture for creating collaborative semantically capable scientific data sharing infrastructures. Proceeding WIDM '06 Proceedings of the 8th annual ACM international workshop on Web information and data management. ACM Digital Library pp. 75-82 (2006).
Jang et al.: Characterization of T cell repertoire of blood, tumor, and ascites in ovarian cancer patients using next generation sequencing. Oncoimmunology, 4(11):e1030561:1-10 (2015).
MLAB 2321 Molecular Diagnostics for Clinical Laboratory Science. Mar. 6, 2015.
Novartis Institutes for Biomedical Research) Immunoglobulin Heavy Chain [Homo sapiens]. National Center for Biotechnology Information. Genbank Entry. pp. 1-2 (2018) https://www.ncbi.nlm.nih.gov/nuccore/MH975524.1ttps://https://www.ncbi.nlm.nih.gov/nuccore/MH975524.1.
(Novartis Institutes for Biomedical Research) Immunoglobulin Lambda Chain [Homo sapiens]. National Center for Biotechnology Information. Genbank Entry, pp. 1-2 (2018) https://www.ncbi.nlm.nih.gov/nuccore/MH975524.1.
Nucleic acid thermodynamics. Wikipedia. Feb. 4, 2021.
O'Driscoll et al.: Synthetic DNA: The next generation of big data storage. Bioengineered. 4(3):123-125 (2013).
PCT/US2019/032992 International Preliminary Report on Patentability dated Nov. 24, 2020.
PCT/US2020/019986 International Search Report and Written Opinion dated Jul. 29, 2020.
PCT/US2020/019988 International Search Report and Written Opinion dated Jul. 29, 2020.
PCT/US2020/038679 International Search Report and Written Opinion dated Oct. 28, 2020.
PCT/US2020/052291 Invitation to Pay Additional Fees dated Dec. 31, 2020.
PCT/US2020/052291 International Search Report and Written Opinion dated Mar. 10, 2021.
PCT/US2020/052306 International Search Report and Written Opinion dated Mar. 2, 2021.
PCT/US2020/052306 Invitation to Pay Additional Fees dated Dec. 18, 2020.
PONSEL. High Affinity, Developability and Functional Size: The Holy Grail of Combinatorial Antibody Library Generation. Molecules. 16:3675-3700 (2011).
PubChem Data Sheet Dichloromethane. Printed from website https://pubchem.ncbi.nlm.nih.gov/compound/Dichloromethane (2020).
Shipman et al.: Molecular recordings by directed CRISPR spacer acquisition. Science. 353(6298):1-16 (2016).
U.S. Appl. No. 15/156,134 Office Action dated Nov. 25, 2020.
U.S. Appl. No. 15/619,322 Office Action dated Nov. 4, 2020.
U.S. Appl. No. 15/835,342 Final Office Action dated Sep. 8, 2020.
U.S. Appl. No. 16/039,256 Office Action dated Aug. 20, 2020.
U.S. Appl. No. 16/384,678 Final Office Action dated Oct. 15, 2020.
U.S. Appl. No. 16/535,777 Final Office Action dated Oct. 20, 2020.
U.S. Appl. No. 16/535,777 Office Action dated Feb. 8, 2021.
U.S. Appl. No. 16/798,275 Office Action dated Feb. 10, 2021.
Van der Velde: Thesis. Finding the Strength of Glass. Delft University of Technology. 1-16 (2015).
Xu et al.: Coordination between the Polymerase and 5'-Nuclease Components of DNA Polymerase 1 of Escherichia coli. The Journal of Biological Chemistry. 275(27):20949-20955 (2000).
Yazdi et al.: DNA-Based Storage: Trends and Methods. IEEE Transactions on Molecular, Biological and Multi-Scale Communications. IEEE. 1(3):230-248 (2016).
Berg: Biochemistry. 5th ED. New York (2002) 148-149.
Borda et al.: Secret writing by DNA hybridization. Acta Technica Napocensis Electronics and Telecommunications. 50(2):21-24 (2008).
GE Healthcare. AKTA oligopilot plus. Data File 18-114-66 AD© . 8 pages (2006).
GE Healthcare. Robust and cost-efficient oligonucleotide synthesis. Application Note 28-4058-08 AA. 4 pages (2005).
Hudson: Matrix Assisted Synthetic Transformations: A Mosaic of Diverse Contributions. Journal of Combinatorial Chemistry. 1(6):403-457 (1999).
Kalva et al.: Gibson Deletion: a novel application of isothermal in vitro recombination. Biological Procedures Online. 20(1):1-10 (2018).
Lebl et al.: Economical Parallel Oligonucleotide and Peptide Synthesizer—Pet Oligator. Int. J. Peptide Res. Ther. 13(1-2):367-376 (2007).
Momentiv. Technical Data Sheet. Silquest A-1100. Momentiv. 1-6 (2020).
Opposition to European Patent No. 3030682 filed Mar. 3, 2021.
PCT/US2019/068435 International Preliminary Report on Patentability dated Jul. 8, 2021.
PCT/US2020/064106 International Search Report and Written Opinion dated Jun. 3, 2021.
PCT/US2020/064106 Invitation to Pay Additional Fees dated Apr. 9, 2021.
Pigott et al.: The Use of a Novel Discovery Platform to Identify Peptide-Grafted Antibodies that Activate GLP-1 Receptor Signaling. Innovative Targeting Solutions Inc. (2013) XP055327428 retrieved from the internet: http://www.innovativetargeting.com/wo-content/uploads/2013/12/Pigott-et-al-Antibody-Engineering-2013.pdf.
U.S. Appl. No. 15/156,134 Final Office Action dated Aug. 18, 2021.
U.S. Appl. No. 15/245,054 Notice of Allowance dated Dec. 14, 2017.
U.S. Appl. No. 15/272,004 Final Office Action dated Mar. 18, 2021.
U.S. Appl. No. 15/619,322 Final Office Action dated Jul. 9, 2021.
U.S. Appl. No. 15/835,342 Office Action dated Apr. 16, 2021.
U.S. Appl. No. 15/902,855 Restriction Requirement dated Apr. 6, 2021.
U.S. Appl. No. 15/921,479 Office Action dated Apr. 27, 2021.
U.S. Appl. No. 16/039,256 Final Office Action dated Mar. 30, 2021.
U.S. Appl. No. 16/854,719 Restriction Requirement dated Jul. 28, 2021.
U.S. Appl. No. 16/906,555 Office Action dated Aug. 17, 2021.
U.S. Appl. No. 17/154,906 Restriction Requirement dated Jul. 26, 2021.
De Graff et al.: Glucagon-Like Peptide-1 and its Class B G Protein-Coupled Receptors: A Long March to Therapeutic Successes. Pharmacol Rev. 68(4):954-1013 (2016).
PCT/US2020/019371 International Preliminary Report on Patentability dated Sep. 2, 2021.
PCT/US2020/019986 International Preliminary Report on Patentability dated Sep. 10, 2021.
PCT/US2020/019988 International Preliminary Report on Patentability dated Sep. 10, 2021.
U.S. Appl. No. 17/154,906 Office Action dated Nov. 10, 2021.
U.S. Appl. No. 16/712,678 Restriction Requirement dated Aug. 25, 2021.
U.S. Appl. No. 16/712,678 Office Action dated Nov. 26, 2021.
U.S. Appl. No. 16/737,401 Restriction Requirement dated Nov. 15, 2021.
U.S. Appl. No. 16/802,439 Restriction Requirement dated Oct. 1, 2021.
U.S. Appl. No. 16/879,705 Office Action dated Sep. 9, 2021.

(56) References Cited

OTHER PUBLICATIONS

U.S. Appl. No. 16/798,275 Final Office Action dated Aug. 30, 2021.
U.S. Appl. No. 16/854,719 Office Action dated Nov. 24, 2021.

* cited by examiner

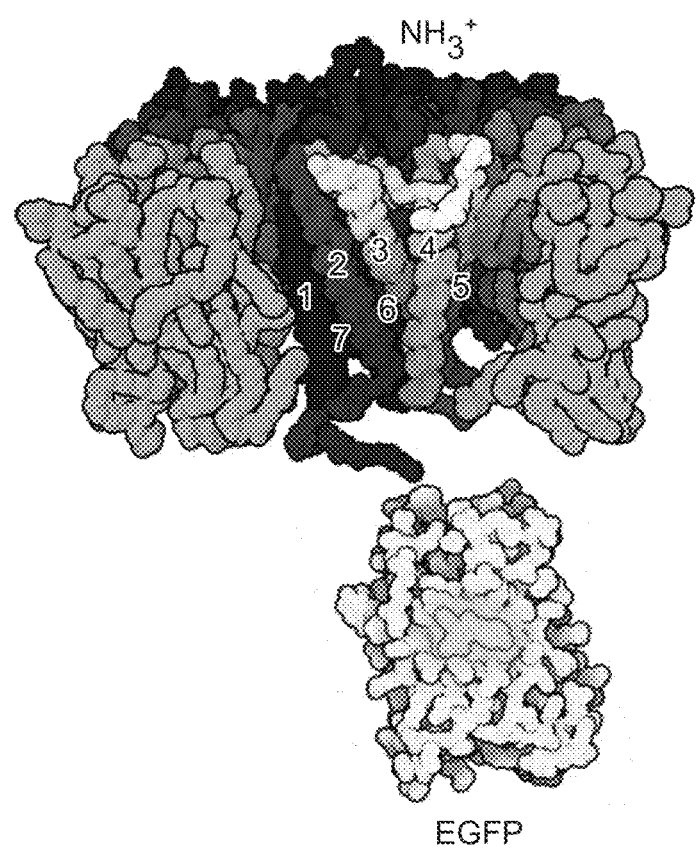
FIG. 4

```
9 IGHV3-20;IGKV3-20 *
IGHV1-69;CAMQFTSFDYIWGSYPAAENYNNEMDVW;    CQQYSSEPITF    ;AHFSSYAFN;GRIIPALGVTNYA;RASPNVGSRSLA;IGKV3-20
IGHV1-69;CARAVYNYGGSISLEDSDYYYYYMEVW;     CQQYGRSQTF     ;DIFSDYAIT;GGIVPIFGISKKA;RASQSVTSGHLA;IGKV3-20
IGHV1-69;CARGAAESMGVCNTRSNYFSFGMDVW;      CQQYGDFPPITF   ;GGFSNYAIS;GGTIPLFDTTHYA;RASQSVTSNYLA;IGKV3-20
IGHV1-69;CARGPRWARDIAEGRPGYYHYVLDVW;      CQQYGSSPRTF    ;DHLSYIIT;GDIIPLPTLGTHDYE;RASQTVSGKFVA;IGKV3-20
IGHV1-69;CARVNCSTSQVLRAPTYYYYGMDVW;       CQQYGSSPLIF    ;GTFSSYAIS;GGIIPIFGTANYA;RASQSVSSSYLA;IGKV3-20
IGHV1-69;CASGLLNQFDTSSLHYNKFFYGMDVW;      CQQYGDSIGTF    ;GSFLTYAIS;GRITPVNGKANHA;RASQSVSDTSIA;IGKV3-20
IGHV1-69;CASGPLVGFDTSSLHYSQLFYGMDVW;      CQHYGDSTGTF    ;GTLVTHAIT;GRITPINGKANHA;RASQSVRSTSIA;AASTRVT;IGKV3-20
IGHV1-69;CATQSTNDEVDGLLGDDSYFMDVW;        CQQYGTHHTF     ;GIFSNFGVS;GGIFPLGGIPSYA;RASQSFSDVYLA;ATSSRAP;IGKV3-20
IGHV1-69;CAVAFNNDYLRGNYRSPGRSWLESW;       CQQYGTSPTF     ;GTFSSYAIS;GGIIPIFGSADYA;RASQSISTSLA;GASSRAT;IGKV3-20

7 IGHV1-69;IGKV2-28
IGHV1-69;CAGGKHHRRIVVENAISYDYYYGMDVW;     CMQALQTPPYTF   ;GLFYSYGIN;GGIPELGPANYA;RSSQSLLQHSNGNNYLD;LGSNRAS;IGKV2-28
IGHV1-69;CARDRGQISYVWGSYRYLEYYGMDVW;      CMQALQTPRLTF   ;GTFSTYGIN;GGIIPLFNITHA;RSSQSLLHSNGNNYLD;LGSNRAS;IGKV2-28
IGHV1-69;CARDRSVRGVVSEVSPPHFHHGMDVW;      CMQALQTPWTF    ;ASFQSYTIN;GRITPLLGSIHLA;RSSQSLRHSNGHHYVD;SASNRAS;IGKV2-28
IGHV1-69;CARWSRWKQAGATSVGAKPFGNORFYYGMDVW; CMQALQPAHTF   ;GTFESTYSLS;GMVIPALRITMLA;KSSQSLLDSNGYNYLD;LGSNRAS;IGKV2-28
IGHV1-69;CASAVVIDIPGKPGKSRGNFGFYYGLDVW;   CMQALQTPMYTF   ;GTFSNYAIT;GGIIPLFDVTKSS;RSSQSLLHSSGYNHLD;LASNRAS;IGKV2-28
IGHV1-69;CASAVVIEIPGKPGKTRGNFGYYYGLDVW;   CMQALQNPMYTF   ;GTFTNYGIS;GAIIPLFDTIRSA;RSSQSLLHSSGYNYLD;LASNRAS;IGKV2-28
IGHV1-69;CASLPDSSDWYVSSPGGEYYGLDVW;       CMQALQTPPTF    ;GTFSSYAIS;GGIIPVFGTVHYA;RSSQSLLHSNGYNYLD;LGSNRAS;IGKV2-28

5 IGHV1-69;IGKV4-1
IGHV1-69;CAGGIWAGELYPSLPGYYYNYGMDVW;     CHQYYSSPYSF;DTFSRYSII;GGIIPMSATANYA;KSSQTILYSLNKNYLA;WASTRGS;IGKV4-1
IGHV1-69;CARDSHDLTLVGGVIDYHYYGMDVW;      CQQYFSTPPTF;GFFSTYVIT;GRVIPTLDKADYA;KSSQSLLHSSSKSYLT;WASTRES;IGKV4-1
IGHV1-69;CARERTDTSGDIGDSNLYYYYGMDVW;     CQQYNSPRTF;DTFSRHAIS;GGIIPLYDAANYA;KASQSVLHSNHKNYLG;WASTRES;IGKV4-1
IGHV1-69;CARGEDLKKDSSGHYYWDRIPYSYFDSM;   CQQYYITPQTF;GTFENYAIS;GGILPLFGKPDYA;KSSQLFYSSNNKTYLA;WASTRES;IGKV4-1
IGHV1-69;CARGGFSPRITMVREIISYYYYMDVW;     CQQYYSLPTF;GFFSGHAIS;GGIIPLFDTSNYA;KSSQSVLYSSNNKNYLA;WASTRES;IGKV4-1

8 IGHV3-30/33rn;IGKV2-28
IGHV3-30/33rn;CAKAMGQSGTTCSVSWGYFYALDVW;   CMQALQTPYTF;FTLSGYGMH;AVISPNGSNKYYA;RSSQSLLYANRYNYLD;LGSNRAS;IGKV2-28
IGHV3-30/33rn;CAKGGDSSATCSYGGTSASNCAGYYYYGMDVW;CMQTLEIPTF;FSFKNFAMH;SLISYDGKKKSYV;RSSQSLLESNGIYNIN;LASNRAS;IGKV2-28
IGHV3-30/33rn;CAKDRAREDLRFLDWPSTPHYDMDVW;  CMQALOSPYTE;FSVSSYAMN;SVISYPGRSEHYV;RSSQSLLSRNKIYLD;FGSNRAS;IGKV2-28
IGHV3-30/33rn;CARALGWGTSQSVSWGYYYYALEVW;   CMQTEIPLIF;FTLSGYGMH;AVISPNGNNKYYA;RSSQSLLYRNRYNYLD;LGSNRAS;IGKV2-28
IGHV3-30/33rn;CARGSRMAHCLSISQSHYYYGMDVW;   CMQTEIPLIE;FMFNMYGIH;ALISHDGNNKYYA;RSSQSLLHSDGNIKYYA;RSSQSLLHSNGYNYLD;LGSNRAS;IGKV2-28
IGHV3-30/33rn;CARGGFSNAGYYYGLEVW;         CMQSLQTPPTF;FTFSNYPMH;AVISYDGNIKYYA;RSSQSLLHSNGYNVD;LGSTRAS;IGKV2-28
IGHV3-30/33rn;CGRGIGGQCNSPTQWPPGGYYGLEVW;

```
5 IGHV4-59/61;IGKV1-39
IGHV4-59/61;CARDNLLDIVVPAAMEPDANYYYHGMDVW;    CQQSYNTPSLTF;GSINSGGSYYWN;GRIYTSGDTNYN;RASQSINNYLN;AASSLQS;IGKV1-39
IGHV4-59/61;CARDSLITDIVVPADQRVYYIGMDVW;       CQQSYSTPRAF;GSISSYYMS;GYIYYSGSTNYN;RASQSISSYIN;AASSLQS;IGKV1-39
IGHV4-59/61;CARGAKERVVMVRGVIKSDYGLDVW;        CQQSHSIPRTF;ASIRTYFWS;GYIYYGGKTDYN;RASQSVSNYLN;AALSLQS;IGKV1-39
IGHV4-59/61;CARIHYTSGSYLSWAGESIIDYHGMDVW;     CQQSSVLPLTF;GVTSDSYYWS;GHIYYSGNTNYH;RASESISDYLH;GAYRLQS;IGKV1-39
IGHV4-59/61;CARSWGKLAGELTPYSTSAIGHFDFW;       CQQNFSLYVTF;GSVSSGNYFWS;GYIHHTGTTKFN;RSSQKISESLN;GTSNLQR;IGKV1-39

5 IGHV4-39;IGKV3-20
IGHV4-39;CARHNLPFWASVNGTVAGHGLIDFW;           CQQYGSSPLTF;  GSISSNNYFWG;GTIYYTGRTYYN;RASQSVSGGSYLA;GASSRAT;IGKV3-20
IGHV4-39;CARVGYNSANKPVGVWFGQFYGLDVW;          CQQYGTSVWTF;  GSITDNSYYWG;GRINNHGRTYYS;RASQSVNSMSLA;GASNRAT;IGKV3-20
IGHV4-39;CEKHASAYDFWSGSYNMNYYGMDVW;           CQQYGSSPLYSF; GSISSSNYYWG;GCIYYSGTTYYN;RASQSISSSNLA;GASSRAT;IGKV3-20
IGHV4-39;CVRHPFWSGFETSGAQRGQYFDFW;            CQQISDSPPTF;  GSVSSRGYQWG;GTVYYSGNTYYT;RASQRISSSYLA;GASSRAT;IGKV3-20
IGHV4-39;CVRSRKAGVILGFSGGVQNYIPGYFDYW;        CQHGTSSRDTF; GSISSPNFHWG;GSVHYNGNTHYN;RASQRVTSRYLA;GASTRAT;IGKV3-20

5 IGHV3-23;IGKV3-11
IGHV3-23;CAKEGFVLTLSGGITLLRGPISAYYDYGMDVW;CQQRSF       ;ITFNSYAMG;SSISSPSDSTYYA;RASQSVGSDLA;DASSRAT;IGKV3-11
IGHV3-23;CAKNLEKSKIVVVPAANPPHAFDIW;           CQQRSNWPITF; FTFSSYAMS;SAISGSGGSTYYA;RASQSVSSSYLA;DASNRAT;IGKV3-11
IGHV3-23;CAKSVSYYSHLSPTDPSNFWYSDIW;           CQQRTSWLF;   FTFSGYAMS;SGISASGDKAISA;RTSQTTNNYLA;DAFNRAT;IGKV3-11
IGHV3-23;CARDILGKEMPKVKVYGWYFDIW;             CQHRNNWPPRVTF;FTFSNHAMY;SAIAGFSSSYYA;RASQSVGTFLA;DASSRAT;IGKV3-11
IGHV3-23;CVGWRLCGNERCQQSVWLCGYSLDVW;          CQQRRDWPTF;  ISFNTYVMT;AGVSGGATGTYYA;RASRNIDFHLA;DASNRAT;IGKV3-11

5 IGHV2-23;IGKV2-28
IGHV3-23;CAKAAGCSGGSCHREWGFYYYAMAVW;          CMQALQTPYTF; FMFGSYAMS;SVISGSGDGTYYA;RSSQSLLYYNNEYNYLD;LSSTRAS;IGKV2-28
IGHV3-23;CAKGGDYPGYCRSPSCYRHFYYYGLDVW;        CMQALQTPRTF; FTFSSYAMS;SGISGGGSTYYA;RSSQSLLHSNGYNYLD;LGSNRAS;IGKV2-28
IGHV3-23;CAKGSGIMTLLRGPATVNVGYYGMDVW;         CMQALQIPPAF; FAFSSDPMS;SVISSSGSSTDYA;RSSQSLLHSNGYNYLD;LGFNRAS;IGKV2-28
IGHV3-23;CAKLGATRPNIAVIPVAVDMKKATVKRGSEATDYW;CMQGLQTPYTF;FTLTSDAMS;SSISDSGKTDYA;RSSQLLHDLGVNYLD;LGSNRAS;IGKV2-28
IGHV3-23;CARSSPVNKCSTTVKHYYYNGLDVW;           CMQALQTPHTF; FIFSNYPMS;SAISSNSGTPYYA;RSSQSLLHINEYNYLD;LASNRAS;IGKV2-28

5 IGHV3-21;IGKV3-20
IGHV3-21;CARDLFTPGRLFSGVVEYVYHGMDVW;          CQQFRISPPTF   ;FSLSNYSLN;SSSAGRYHIDYA;RASQSVGSTYFA;GASSRAT;IGKV3-20
IGHV3-21;CARDLIKSWYTTSGVRVVPNYDFAMDVW;        CQHYDTSLGYTF  ;FTFNDFSMN;SSISSGSTFIYYA;RASESVSSTYLA;GASSRRAT;IGKV3-20
IGHV3-21;CARDNVGHYYDSSGYHAYYYGMDVW;           CQQYGSSF      ;FTFSSYSMN;SSISSSSYIYYA;RASQSVSSSYLA;GASSRAT;IGKV3-20
IGHV3-21;CARENLFLISGASGLLVRDYNGLDVW;          CQHYGTSPRITF  ;FIFSSYGMT;SSINDTSTYINYA;RASQSVSRAYLA;GASNRAT;IGKV3-20
IGHV3-21;CASLFITMVREVIPQGHYYGMDVW;            CQQYGSSPFLTE  ;FTFSSYSMN;SSISSSSYIYYA;RASQSVSSSYLA;GASSRAT;IGKV3-20

4 IGHV4-39;IGLV2-14
IGHV4-39;CARPLASIFGVVLMGHGGYYFDHW;            CSSYTSNTVVF   ;DSISNNHYYWG;GSLSSTGSTYHK;TGTSIDLNNYQFVS;EVSSRPS;IGLV2-14
IGHV4-39;CARDQLGGDFWSGHHNLIYFYYAMDVW;         CSSYTSSNTVLF  ;GSITSTTNFWA;GHIYYDGTTHYN;TGTSSDVGGFNYVS;EVSHRPS;IGLV2-14
IGHV4-39;CARRVFGYYYDRSGHYRVVHDAFDIW;          CSSYTRSSTVVF  ;GSISSSSFHWG;GNIFYTGSTYYN;TGTSSDVGGYNYVS;DVSNRPS;IGLV2-14
IGHV4-39;CASGHSAYYDFWSGYLRLNDAFDIW;           CSSYTSASTHVIF ;ASISTSSYYWG;GSVYYSGSTYYN;TGTSSDIGGYKYVS;AVNNRPS;IGLV2-14
```

FIG. 12C

| PDB ID | CDR-H3 | CDR-H3 length | |
|---|---|---|---|
| 4ocw_H_mol | CARDLRELECEEWTLYNYYDFGSRGPCVDPRGVAGSFDVW | 40 | VRC26 |
| 4od3_H_mol | CAKDLREDECEEWWSDYYQFGKKLPCRKSRGVAGVFDKW | 39 | VRC26 |
| 4ocs_H_mol | CAKDMREYECEYWTSDYYDFGRPQPCIDRRGVVGIFDMW | 39 | VRC26 |
| 4odl_H_mol | CAKDLREDECEEWWSDYYDFGKQLPCRKSRGVAGIFDGW | 39 | VRC26 |
| 4odh_H_mol | CAKDLGESENEEWATDYYDFSIGYPGQDPRGVVGAFDIW | 39 | VRC26 |
| 3uls_H_mol | CLTGSKHRLRDYFLYNEYGPNYEEWGDYLATLDVW | 35 | VRC26 |
| 3mug_H_mol | CAREAGGPIWHDDVKYYDFNDGYYNYHYMDVW | 32 | PG16 |
| 3lrs_E_mol | CAREAGGPIWHDDVKYYDFNDGYYNYHYMDVW | 32 | PG16 |
| 3mme_C_mol | CAREAGGPIWHDDVKYYDFNDGYYNYHYMDVW | 32 | PG16 |
| 3u36_H_mol | CVREAGGPDYRNGYNYYDFYDGYYNYHYMDVW | 32 | PG16 |
| 3u36_C_mol | CVREAGGPDYRNGYNYYDFYDGYYNYHYMDVW | 32 | PG16 |
| 3mme_A_mol | CAREAGGPIWHDDVKYYDFNDGYYNYHYMDVW | 32 | PG16 |
| 3lrs_C_mol | CAREAGGPIWHDDVKYYDFNDGYYNYHYMDVW | 32 | PG16 |
| 3mug_J_mol | CAREAGGPIWHDDVKYYDFNDGYYNYHYMDVW | 32 | PG16 |
| 3mug_D_mol | CAREAGGPIWHDDVKYYDFNDGYYNYHYMDVW | 32 | PG16 |
| 3mug_B_mol | CAREAGGPIWHDDVKYYDFNDGYYNYHYMDVW | 32 | PG16 |
| 3u4e_A_mol | CVREAGGPDYRNGYNYYDFYDGYYNYHYMDVW | 32 | PG16 |
| 3u2s_H_mol | CVREAGGPDYRNGYNYYDFYDGYYNYHYMDVW | 32 | PG16 |
| 3u4e_H_mol | CVREAGGPDYRNGYNYYDFYDGYYNYHYMDVW | 32 | PG16 |
| 3lrs_H_mol | CAREAGGPIWHDDVKYYDFNDGYYNYHYMDVW | 32 | PG16 |
| 3mme_H_mol | CAREAGGPIWHDDVKYYDFNDGYYNYHYMDVW | 32 | PG16 |
| 3mug_F_mol | CAREAGGPIWHDDVKYYDFNDGYYNYHYMDVW | 32 | PG16 |
| 3u2s_A_mol | CVREAGGPDYRNGYNYYDFYDGYYNYHYMDVW | 32 | PG16 |
| 3lrs_A_mol | CAREAGGPIWHDDVKYYDFNDGYYNYHYMDVW | 32 | PG16 |
| 3u36_A_mol | CVREAGGPDYRNGYNYYDFYDGYYNYHYMDVW | 32 | PG16 |
| 3u36_E_mol | CVREAGGPDYRNGYNYYDFYDGYYNYHYMDVW | 32 | PG16 |
| 3mug_L_mol | CAREAGGPIWHDDVKYYDFNDGYYNYHYMDVW | 32 | PG16 |
| 4dqo_H_mol | CAREAGGPIWHDDVKYYDFNDGYYNYHYMDVW | 32 | PG16 |
| 4nuj_B_mol | CARMFQESGPPRFDSWSGRNYYYYSGMDVW | 30 | PGT152 |
| 4nug_H_mol | CARMFQESGPPRLDRWSGRNYYYYSGMDVW | 30 | PGT152 |
| 3q6g_I_mol | CARDVVITSHEDDFGDYYTGEYYGLDSW | 29 | rmAb |
| 3q6g_H_mol | CARDVVITSHEDDFGDYYTGEYYGLDSW | 29 | rmAb |
| 1rzf_H_mol | CASNSIAGVAAAGDYADYDGGYYYDMDVW | 29 | loop-d-loop |
| 1jto_A_mol | CAADSTIYASYYECGBGLSTGGYGYDSW | 28 | |
| 4fqr_c_mol | CAKHMSMQQVVSAGWERADLVGDAFDVW | 28 | |
| 4fqr_m_mol | CAKHMSMQQVVSAGWERADLVGDAFDVW | 28 | |
| 4fqr_i_mol | CAKHMSMQQVVSAGWERADLVGDAFDVW | 28 | |
| 4fqr_k_mol | CAKHMSMQQVVSAGWERADLVGDAFDVW | 28 | |
| 4fqr_u_mol | CAKHMSMQQVVSAGWERADLVGDAFDVW | 28 | |
| 4fnl_I_mol | CAKHMSMQQVVSAGWERADLVGDAFDVW | 28 | |
| 4fqr_w_mol | CAKHMSMQQVVSAGWERADLVGDAFDVW | 28 | |

FIG. 13

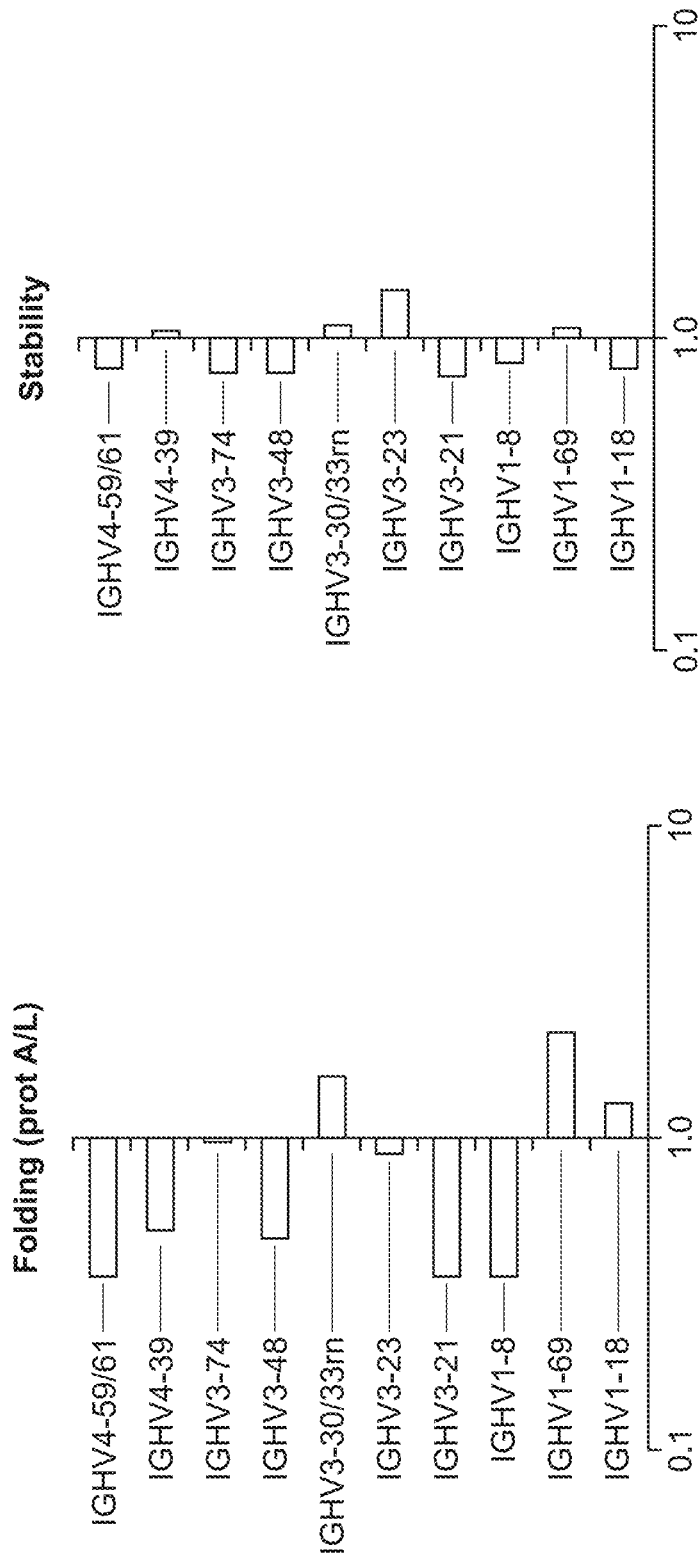

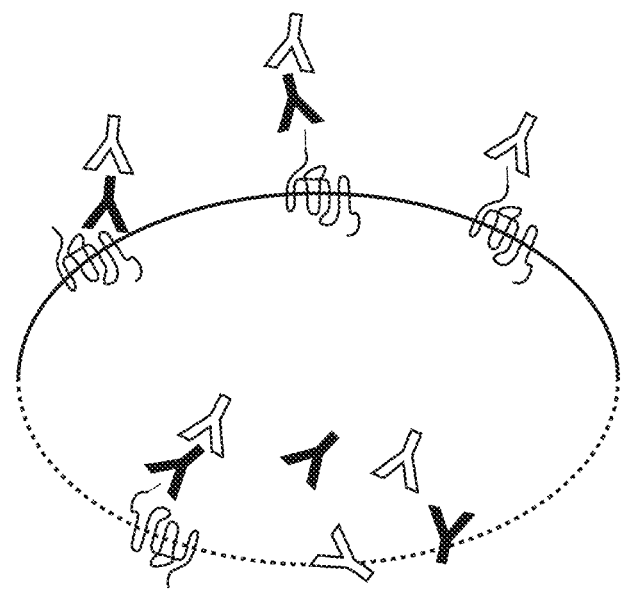
FIG. 19A
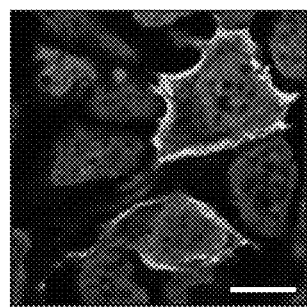 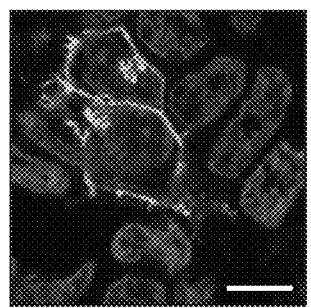
FIG. 19B              FIG. 19C

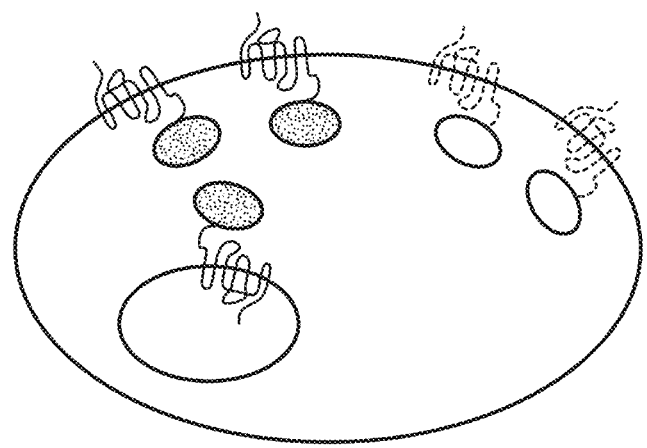
FIG. 20A
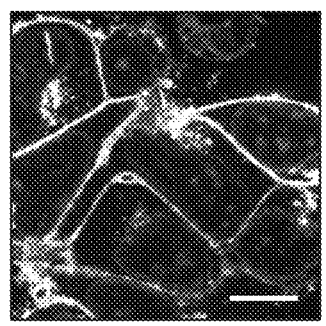 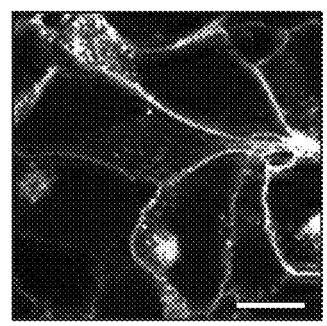
FIG. 20B        FIG. 20C

GPCR BINDING PROTEINS AND SYNTHESIS THEREOF

CROSS-REFERENCE

This application claims the benefit of U.S. Provisional Patent Application No. 62/556,863 filed on Sep. 11, 2017 which is incorporated herein by reference in its entirety.

SEQUENCE LISTING

The instant application contains a Sequence Listing which has been submitted electronically in ASCII format and is hereby incorporated by reference in its entirety. Said ASCII copy, created on Sep. 20, 2018, is named 44854-741_201_SL.txt and is 943,473 bytes in size.

BACKGROUND

G protein-coupled receptors (GPCRs) are implicated in a wide variety of diseases. Raising antibodies to GPCRs has been difficult due to problems in obtaining suitable antigen because GPCRs are often expressed at low levels in cells and are very unstable when purified. Thus, there is a need for improved agents for therapeutic intervention which target GPCRs.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF SUMMARY

Provided herein are antibodies comprising a CDR-H3 comprising a sequence of any one of SEQ ID NOS: 2420 to 2436. Provided herein are antibodies comprising a CDR-H3 comprising a sequence of any one of SEQ ID NOS: 2420 to 2436; and wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Provided herein are antibodies wherein the VH domain is IGHV1-18, IGHV1-69, IGHV1-8 IGHV3-21, IGHV3-23, IGHV3-30/33m, IGHV3-28, IGHV3-74, IGHV4-39, or IGHV4-59/61. Provided herein are antibodies, wherein the VL domain is IGKV1-39, IGKV1-9, IGKV2-28, IGKV3-11, IGKV3-15, IGKV3-20, IGKV4-1, IGLV1-51, or IGLV2-14. Provided herein are methods of inhibiting GLP1R activity, comprising administering the antibodies as described herein. Provided herein are methods for treatment of a metabolic disorder, comprising administering to a subject in need thereof the antibodies as described herein. In some instances, the antibody comprises a CDR-H3 comprising a sequence of any one of SEQ ID NOS: 2420 to 2436. Provided herein are methods for treatment of a metabolic disorder, wherein the metabolic disorder is Type II diabetes, or obesity. Provided herein are nucleic acids encoding for a protein comprising a sequence of any one of SEQ ID NOS: 2420 to 2436.

Provided herein are nucleic acid libraries comprising a plurality of nucleic acids, wherein each nucleic acid encodes for a sequence that when translated encodes for an immunoglobulin scaffold, wherein the immunoglobulin scaffold comprises a CDR-H3 loop that comprises a GPCR binding domain, and wherein each nucleic acid comprises a sequence encoding for a sequence variant of the GPCR binding domain. Provided herein are nucleic acid libraries, wherein a length of the CDR-H3 loop is about 20 to about 80 amino acids. Provided herein are nucleic acid libraries, wherein a length of the CDR-H3 loop is about 80 to about 230 base pairs. Provided herein are nucleic acid libraries, wherein the immunoglobulin scaffold further comprises one or more domains selected from variable domain, light chain (VL), variable domain, heavy chain (VH), constant domain, light chain (CL), and constant domain, heavy chain (CH). Provided herein are nucleic acid libraries, wherein the VH domain is IGHV1-18, IGHV1-69, IGHV1-8 IGHV3-21, IGHV3-23, IGHV3-30/33rn, IGHV3-28, IGHV3-74, IGHV4-39, or IGHV4-59/61. Provided herein are nucleic acid libraries, wherein the VL domain is IGKV1-39, IGKV1-9, IGKV2-28, IGKV3-11, IGKV3-15, IGKV3-20, IGKV4-1, IGLV1-51, or IGLV2-14. Provided herein are nucleic acid libraries, wherein a length of the VH domain is about 90 to about 100 amino acids. Provided herein are nucleic acid libraries, wherein a length of the VL domain is about 90 to about 120 amino acids. Provided herein are nucleic acid libraries, wherein a length of the VH domain is about 280 to about 300 base pairs. Provided herein are nucleic acid libraries, wherein a length of the VL domain is about 300 to about 350 base pairs. Provided herein are nucleic acid libraries, wherein the library comprises at least 10⁵ non-identical nucleic acids. Provided herein are nucleic acid libraries, wherein the immunoglobulin scaffold comprises a single immunoglobulin domain. Provided herein are nucleic acid libraries, wherein the immunoglobulin scaffold comprises a peptide of at most 100 amino acids. Provided herein are vector libraries comprising nucleic acid libraries as described herein. Provided herein are cell libraries comprising nucleic acid libraries as described herein.

Provided herein are nucleic acid libraries comprising a plurality of nucleic acids, wherein each nucleic acid encodes for a sequence that when translated encodes a GPCR binding domain, and wherein each nucleic acid comprises sequence encoding for a different GPCR binding domain about 20 to about 80 amino acids. Provided herein are nucleic acid libraries, wherein a length of the GPCR binding domain is about 80 to about 230 base pairs. Provided herein are nucleic acid libraries, wherein the GPCR binding domain is designed based on conformational ligand interactions, peptide ligand interactions, small molecule ligand interactions, extracellular domains of GPCRs, or antibodies that target GPCRs. Provided herein are vector libraries comprising nucleic acid libraries as described herein. Provided herein are cell libraries comprising nucleic acid libraries as described herein.

Provided herein are protein libraries comprising a plurality of proteins, wherein each of the proteins of the plurality of proteins comprise an immunoglobulin scaffold, wherein the immunoglobulin scaffold comprises a CDR-H3 loop that comprises a sequence variant of a GPCR binding domain. Provided herein are protein libraries, wherein a length of the CDR-H3 loop is about 20 to about 80 amino acids. Provided herein are protein libraries, wherein the immunoglobulin scaffold further comprises one or more domains selected from variable domain, light chain (VL), variable domain, heavy chain (VH), constant domain, light chain (CL), and constant domain, heavy chain (CH). Provided herein are protein libraries, wherein the VH domain is IGHV1-18, IGHV1-69, IGHV1-8 IGHV3-21, IGHV3-23, IGHV3-30/33rn, IGHV3-28, IGHV3-74, IGHV4-39, or IGHV4-59/61. Provided herein are protein libraries, wherein the VL domain is IGKV1-39, IGKV1-9, IGKV2-28, IGKV3-11, IGKV3-15, IGKV3-20, IGKV4-1, IGLV1-51, or IGLV2-14. Provided herein are protein libraries, wherein a length of the VH domain is about 90 to about 100 amino acids. Provided herein are protein libraries, wherein a length of the VL domain is about 90 to about 120 amino acids. Provided herein are protein libraries, wherein the plurality of proteins is used to generate a peptidomimetic library. Provided herein are protein libraries, wherein the protein library comprises peptides. Provided herein are protein libraries, wherein the protein library comprises immunoglobulins. Provided herein are protein libraries, wherein the protein library comprises antibodies. Provided herein are cell libraries comprising protein libraries as described herein.

Provided herein are protein libraries comprising a plurality of proteins, wherein the plurality of proteins comprises sequence encoding for different GPCR binding domains, and wherein the length of each GPCR binding domain is about 20 to about 80 amino acids. Provided herein are protein libraries, wherein the protein library comprises peptides. Provided herein are protein libraries, wherein the protein library comprises immunoglobulins. Provided herein are protein libraries, wherein the protein library comprises antibodies. Provided herein are protein libraries, wherein the plurality of proteins are used to generate a peptidomimetic library. Provided herein are cell libraries comprising protein libraries as described herein.

Provided herein are vector libraries comprising a nucleic acid library described herein. Provided herein are cell libraries comprising a nucleic acid library described herein. Provided herein are cell libraries comprising a protein library described herein.

BRIEF DESCRIPTION OF THE DRAWINGS

FIG. 4 depicts a schematic of a GPCR.

FIGS. 12A-12C depict sequences of immunoglobulin scaffolds. FIG. 12A discloses SEQ ID NOS 2437-2453, 2448, 2454-2464, 2448, 2465-2471, 2466, 2472-2483, 2462, 2484-2485, 2448, 2486-2496, 2491, 2497-2507, 2491, 2508-2518, 2513, 2519-2520, 2462, 2521-2522, 2491, 2523-2539, 2534, 2540-2544, 2534, 2545-2549, 2534, 2550-2554, 2491, 2555-2559, 2513, 2560, 2556, 2561-2562, 2496, 2563-2564, 2556, 2565-2567, 2491, 2568-2575, 2552, 2576-2577, 2563, 2578-2581, 2522, 2491, 2582-2585, 2567 and 2563, respectively, in order of appearance. FIG. 12B discloses SEQ ID NOS 2586-2620, 2615, 2621-2631, 2459, 2632-2654, 2448, 2655-2658, 2464, 2448, 2659-2661, 2658, 2662-2672, 2658, 2673-2718, 2657, 2719, 2715, 2720-2728, 2720, 2729-2745, 2734, 2746-2753, 2748-2749 and 2754-2755, respectively, in order of appearance. FIG. 12C discloses SEQ ID NOS 2756-2766, 2761, 2767-2785, 2461, 2786-2788, 2448, 2789-2793, 2459, 2794-2798, 2448, 2799-2803, 2448, 2804-2808, 2734, 2809-2831, 2814, 2832-2836, 2820, 2837, 2551, 2838-2843, 2817, 2844, 2522, 2491, 2845-2848, 2522, 2849-2854, 2491, 2855-2859, 2513, 2860-2864, 2448, 2865-2874, 2464, 2448, 2875-2879, 2459, 2880-2881, 2873-2874, 2464, 2448, 2882-2903, 2608 and 2904, respectively, in order of appearance.

FIG. 13 depicts sequences of G protein-coupled receptors scaffolds. FIG. 13 discloses SEQ ID NOS 2905-2911, 2911, 2911-2912, 2912, 2911, 2911, 2911, 2911-2912, 2912, 2912, 2911, 2911, 2911-2912, 2911-2912, 2912, 2911, 2911, 2913-2915, 2915-2918, 2918, 2918, 2918, 2918 and 2918, respectively, in order of appearance.

FIG. 17A discloses SEQ ID NOS 2919-2924, 2712, 2925-2926, 2725, 2927-2932, 2461, 2933, 2455, 2934-2939, 2730, 2742, 2940-2941, 2556, 2942, 2851, 2498, 2943, 2843, 2944-2945, 2757, 2946-2947, 2774 and 2948, respectively, in order of appearance.

FIG. 17B discloses SEQ ID NOS 2919-2924, 2712, 2925-2926, 2725, 2927-2932, 2461, 2933, 2455, 2934-2939, 2730, 2742, 2940-2941, 2556, 2942, 2851, 2498, 2943, 2843, 2944-2945, 2757, 2946-2947, 2774 and 2948, respectively, in order of appearance.

FIG. 17C discloses SEQ ID NOS 2919-2924, 2712, 2925-2926, 2725, 2927-2932, 2461, 2933, 2455, 2934-2939, 2730, 2742, 2940-2941, 2556, 2942, 2851, 2498, 2943, 2843, 2944-2945, 2757, 2946-2947, 2774 and 2948, respectively, in order of appearance.

FIG. 17D discloses SEQ ID NOS 2919-2924, 2712, 2925-2926, 2725, 2927-2932, 2461, 2933, 2455, 2934-2939, 2730, 2742, 2940-2941, 2556, 2942, 2851, 2498, 2943, 2843, 2944-2945, 2757, 2946-2947, 2774 and 2948, respectively, in order of appearance.

FIG. 18A is a plot of heavy chain frameworks assayed for folding.

FIG. 18B is a plot of heavy chain frameworks assayed for stability.

FIGS. 19A-19C depict images of G protein-coupled receptors visualized by fluorescent antibodies.

FIGS. 20A-20C depict images of G protein-coupled receptors visualized by auto-fluorescent proteins.

DETAILED DESCRIPTION

Figure 1:
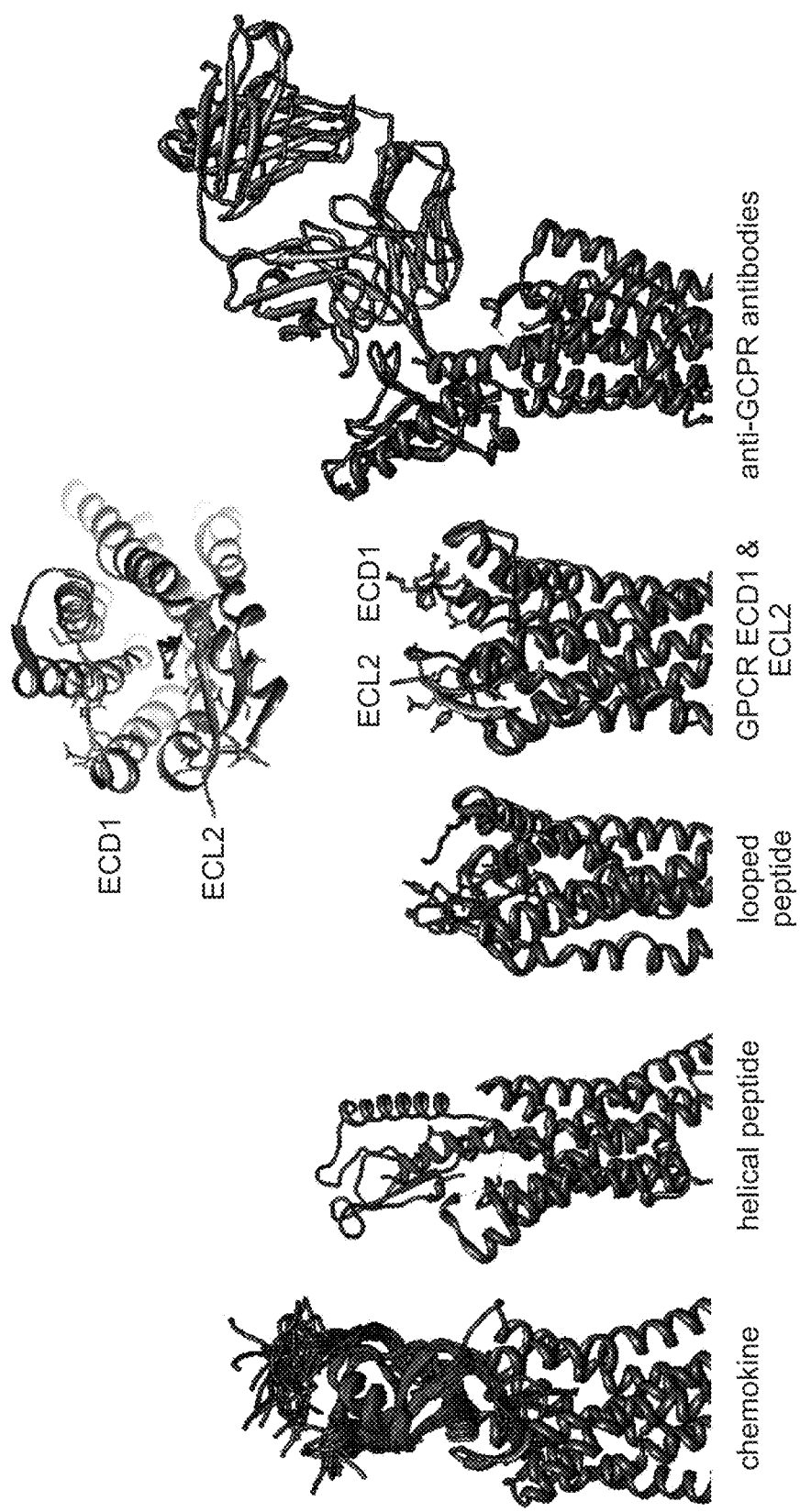
FIG. 1 depicts a schematic of G protein-coupled receptor (GPCR) ligand interaction surfaces.

The present disclosure employs, unless otherwise indicated, conventional molecular biology techniques, which are within the skill of the art. Unless defined otherwise, all technical and scientific terms used herein have the same meaning as is commonly understood by one of ordinary skill in the art.

Definitions

Throughout this disclosure, various embodiments are presented in a range format. It should be understood that the description in range format is merely for convenience and brevity and should not be construed as an inflexible limitation on the scope of any embodiments. Accordingly, the description of a range should be considered to have specifically disclosed all the possible subranges as well as individual numerical values within that range to the tenth of the unit of the lower limit unless the context clearly dictates otherwise. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual values within that range, for example, 1.1, 2, 2.3, 5, and 5.9. This applies regardless of the breadth of the range. The upper and lower limits of these intervening ranges may independently be included in the smaller ranges, and are also encompassed within the disclosure, subject to any specifically excluded limit in the stated range. Where the stated range includes one or both of the limits, ranges excluding either or both of those included limits are also included in the disclosure, unless the context clearly dictates otherwise.

The terminology used herein is for the purpose of describing particular embodiments only and is not intended to be limiting of any embodiment. As used herein, the singular forms "a," "an" and "the" are intended to include the plural forms as well, unless the context clearly indicates otherwise. It will be further understood that the terms "comprises" and/or "comprising," when used in this specification, specify the presence of stated features, integers, steps, operations, elements, and/or components, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers +/−10% thereof, or 10% below the lower listed limit and 10% above the higher listed limit for the values listed for a range.

Unless specifically stated, as used herein, the term "nucleic acid" encompasses double- or triple-stranded nucleic acids, as well as single-stranded molecules. In double- or triple-stranded nucleic acids, the nucleic acid strands need not be coextensive (i.e., a double-stranded nucleic acid need not be double-stranded along the entire length of both strands). Nucleic acid sequences, when provided, are listed in the 5' to 3' direction, unless stated otherwise. Methods described herein provide for the generation of isolated nucleic acids. Methods described herein additionally provide for the generation of isolated and purified nucleic acids. A "nucleic acid" as referred to herein can comprise at least 5, 10, 20, 30, 40, 50, 60, 70, 80, 90, 100, 125, 150, 175, 200, 225, 250, 275, 300, 325, 350, 375, 400, 425, 450, 475, 500, 600, 700, 800, 900, 1000, 1100, 1200, 1300, 1400, 1500, 1600, 1700, 1800, 1900, 2000, or more bases in length. Moreover, provided herein are methods for the synthesis of any number of polypeptide-segments encoding nucleotide sequences, including sequences encoding non-ribosomal peptides (NRPs), sequences encoding non-ribosomal peptide-synthetase (NRPS) modules and synthetic variants, polypeptide segments of other modular proteins, such as antibodies, polypeptide segments from other protein families, including non-coding DNA or RNA, such as regulatory sequences e.g. promoters, transcription factors, enhancers, siRNA, shRNA, RNAi, miRNA, small nucleolar RNA derived from microRNA, or any functional or structural DNA or RNA unit of interest. The following are non-limiting examples of polynucleotides: coding or non-coding regions of a gene or gene fragment, intergenic DNA, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), small nucleolar RNA, ribozymes, complementary DNA (cDNA), which is a DNA representation of mRNA, usually obtained by reverse transcription of messenger RNA (mRNA) or by amplification; DNA molecules produced synthetically or by amplification, genomic DNA, recombinant polynucleotides, branched polynucleotides, plasmids, vectors, isolated DNA of any sequence, isolated RNA of any sequence, nucleic acid probes, and primers. cDNA encoding for a gene or gene fragment referred herein may comprise at least one region encoding for exon sequences without an intervening intron sequence in the genomic equivalent sequence.

GPCR Libraries

Provided herein are methods and compositions relating to G protein-coupled receptor (GPCR) binding libraries comprising nucleic acids encoding for a scaffold comprising a GPCR binding domain. Scaffolds as described herein can stably support a GPCR binding domain. The GPCR binding domain may be designed based on surface interactions of a GPCR ligand and the GPCR. Libraries as described herein may be further variegated to provide for variant libraries comprising nucleic acids each encoding for a predetermined variant of at least one predetermined reference nucleic acid sequence. Further described herein are protein libraries that may be generated when the nucleic acid libraries are translated. In some instances, nucleic acid libraries as described herein are transferred into cells to generate a cell library. Also provided herein are downstream applications for the libraries synthesized using methods described herein. Downstream applications include identification of variant nucleic acids or protein sequences with enhanced biologically relevant functions, e.g., improved stability, affinity, binding, functional activity, and for the treatment or prevention of a disease state associated with GPCR signaling.

Scaffold Libraries

Provided herein are libraries comprising nucleic acids encoding for a scaffold, wherein sequences for GPCR binding domains are placed in the scaffold. Scaffold described herein allow for improved stability for a range of GPCR binding domain encoding sequences when inserted into the scaffold, as compared to an unmodified scaffold. Exemplary scaffolds include, but are not limited to, a protein, a peptide, an immunoglobulin, derivatives thereof, or combinations thereof. In some instances, the scaffold is an immunoglobulin. Scaffolds as described herein comprise improved functional activity, structural stability, expression, specificity, or a combination thereof. In some instances, scaffolds comprise long regions for supporting a GPCR binding domain.

Provided herein are libraries comprising nucleic acids encoding for a scaffold, wherein the scaffold is an immunoglobulin. In some instances, the immunoglobulin is an antibody. As used herein, the term antibody will be understood to include proteins having the characteristic two-armed, Y-shape of a typical antibody molecule as well as one or more fragments of an antibody that retain the ability to specifically bind to an antigen. Exemplary antibodies include, but are not limited to, a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv) (including fragments in which the VL and VH are joined using recombinant methods by a synthetic or natural linker that enables them to be made as a single protein chain in which the VL and VH regions pair to form monovalent molecules, including single chain Fab and scFab), a single chain antibody, a Fab fragment (including monovalent fragments comprising the VL, VH, CL, and CH1 domains), a F(ab')2 fragment (including bivalent fragments comprising two Fab fragments linked by a disulfide bridge at the hinge region), a Fd fragment (including fragments comprising the VH and CH1 fragment), a Fv fragment (including fragments comprising the VL and VH domains of a single arm of an antibody), a single-domain antibody (dAb or sdAb) (including fragments comprising a VH domain), an isolated complementarity determining region (CDR), a diabody (including fragments comprising bivalent dimers such as two VL and VH domains bound to each other and recognizing two different antigens), a fragment comprised of only a single monomeric variable domain, disulfide-linked Fvs (sdFv), an intrabody, an anti-idiotypic (anti-Id) antibody, or ab antigen-binding fragments thereof. In some instances, the libraries disclosed herein comprise nucleic acids encoding for a scaffold, wherein the scaffold is a Fv antibody, including Fv antibodies comprised of the minimum antibody fragment which contains a complete antigen-recognition and antigen-binding site. In some embodiments, the Fv antibody consists of a dimer of one heavy chain and one light chain variable domain in tight, non-covalent association, and the three hypervariable regions of each variable domain interact to define an antigen-binding site on the surface of the VH-VL dimer. In some embodiments, the six hypervariable regions confer antigen-binding specificity to the antibody. In some embodiments, a single variable domain (or half of an Fv comprising only three hypervariable regions specific for an antigen, including single domain antibodies isolated from camelid animals comprising one heavy chain variable domain such as VHH antibodies or nanobodies) has the ability to recognize and bind antigen. In some instances, the libraries disclosed herein comprise nucleic acids encoding for a scaffold, wherein the scaffold is a single-chain Fv or scFv, including antibody fragments comprising a VH, a VL, or both a VH and VL domain, wherein both domains are present in a single polypeptide chain. In some embodiments, the Fv polypeptide further comprises a polypeptide linker between the VH and VL domains allowing the scFv to form the desired structure for antigen binding. In some instances, a scFv is linked to the Fc fragment or a VHH is linked to the Fc fragment (including minibodies). In some instances, the antibody comprises immunoglobulin molecules and immunologically active fragments of immunoglobulin molecules, e.g., molecules that contain an antigen binding site. Immunoglobulin molecules are of any type (e.g., IgG, IgE, IgM, IgD, IgA and IgY), class (e.g., IgG 1, IgG 2, IgG 3, IgG 4, IgA 1 and IgA 2) or subclass.

Libraries described herein comprising nucleic acids encoding for a scaffold, wherein the scaffold is an immunoglobulin, comprise variations in at least one region of the immunoglobulin. Exemplary regions of the antibody for variation include, but are not limited to, a complementarity-determining region (CDR), a variable domain, or a constant domain. In some instances, the CDR is CDR1, CDR2, or CDR3. In some instances, the CDR is a heavy domain including, but not limited to, CDR-H1, CDR-H2, and CDR-H3. In some instances, the CDR is a light domain including, but not limited to, CDR-L1, CDR-L2, and CDR-L3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH).

Methods described herein provide for synthesis of libraries comprising nucleic acids encoding for a scaffold, wherein each nucleic acid encodes for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the scaffold library comprises varied nucleic acids collectively encoding variations at multiple positions. In some instances, the variant library comprises sequences encoding for variation of at least a single codon of a CDR-H1, CDR-H2, CDR-H3, CDR-L1, CDR-L2, CDR-L3, VL, or VH domain. In some instances, the variant library comprises sequences encoding for variation of multiple codons of a CDR-H1, CDR-H2, CDR-H3, CDR-L1, CDR-L2, CDR-L3, VL, or VH domain. In some instances, the variant library comprises sequences encoding for variation of multiple codons of framework element 1 (FW1), framework element 2 (FW2), framework element 3 (FW3), or framework element 4 (FW4). An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

In some instances, the at least one region of the immunoglobulin for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary genes include, but are not limited to, IGHV1-18, IGHV1-69, IGHV1-8, IGHV3-21, IGHV3-23, IGHV3-30/33rn, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, and IGLV2-14.

Provided herein are libraries comprising nucleic acids encoding for immunoglobulin scaffolds, wherein the libraries are synthesized with various numbers of fragments. In some instances, the fragments comprise the CDR-H1, CDR-H2, CDR-H3, CDR-L1, CDR-L2, CDR-L3, VL, or VH domain. In some instances, the fragments comprise framework element 1 (FW1), framework element 2 (FW2), framework element 3 (FW3), or framework element 4 (FW4). In some instances, the scaffold libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

Libraries comprising nucleic acids encoding for immunoglobulin scaffolds as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the immunoglobulin scaffolds comprise at least or about 100, 200, 300, 400, 500, 600, 700, 800, 900, 1000, 2000, 3000, 4000, 5000, or more than 5000 amino acids.

A number of variant sequences for the at least one region of the immunoglobulin for variation are de novo synthesized using methods as described herein. In some instances, a number of variant sequences is de novo synthesized for CDR-H1, CDR-H2, CDR-H3, CDR-L1, CDR-L2, CDR-L3, VL, VH, or combinations thereof. In some instances, a number of variant sequences is de novo synthesized for framework element 1 (FW1), framework element 2 (FW2), framework element 3 (FW3), or framework element 4 (FW4). The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is at least or about 500, 600, 700, 800, 900, 1000, 2000, 3000, 4000, 5000, 6000, 7000, 8000, or more than 8000 sequences. In some instances, the number of variant sequences is about 10 to 500, 25 to 475, 50 to 450, 75 to 425, 100 to 400, 125 to 375, 150 to 350, 175 to 325, 200 to 300, 225 to 375, 250 to 350, or 275 to 325 sequences.

Variant sequences for the at least one region of the immunoglobulin, in some instances, vary in length or sequence. In some instances, the at least one region that is de novo synthesized is for CDR-H1, CDR-H2, CDR-H3, CDR-L1, CDR-L2, CDR-L3, VL, VH, or combinations thereof. In some instances, the at least one region that is de novo synthesized is for framework element 1 (FW1), framework element 2 (FW2), framework element 3 (FW3), or framework element 4 (FW4). In some instances, the variant sequence comprises at least or about 1, 2, 3, 4, 5, 6, 7, 8, 9, 10, 15, 20, 25, 30, 35, 40, 45, 50, or more than 50 variant nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 additional nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 less nucleotides or amino acids as compared to wild-type. In some instances, the libraries comprise at least or about $10^1$, $10^2$, $10^3$, $10^4$, $10^5$, $10^6$, $10^7$, $10^8$, $10^9$, $10^{10}$, or more than $10^{10}$ variants.

Following synthesis of scaffold libraries, scaffold libraries may be used for screening and analysis. For example, scaffold libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, scaffold libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

In some instances, the scaffold libraries are assayed for functional activity, structural stability (e.g., thermal stable or pH stable), expression, specificity, or a combination thereof. In some instances, the scaffold libraries are assayed for scaffolds capable of folding. In some instances, a region of the antibody is assayed for functional activity, structural stability, expression, specificity, folding, or a combination thereof. For example, a VH region or VL region is assayed for functional activity, structural stability, expression, specificity, folding, or a combination thereof.

GPCR Libraries

Provided herein are G protein-coupled receptor (GPCR) binding libraries comprising nucleic acids encoding for scaffolds comprising sequences for GPCR binding domains. In some instances, the scaffolds are immunoglobulins. In some instances, the scaffolds comprising sequences for GPCR binding domains are determined by interactions between the GPCR binding domains and the GPCRs.

Provided herein are libraries comprising nucleic acids encoding scaffolds comprising GPCR binding domains, wherein the GPCR binding domains are designed based on surface interactions on the GPCRs. Exemplary GPCRs are seen in Table 1. In some instances, the GPCR binding domains interact with the amino- or carboxy-terminus of the GPCR. In some instances, the GPCR binding domains interact with at least one transmembrane domain including, but not limited to, transmembrane domain 1 (TM1), transmembrane domain 2 (TM2), transmembrane domain 3 (TM3), transmembrane domain 4 (TM4), transmembrane domain 5 (TM5), transmembrane domain 6 (TM6), and transmembrane domain 7 (TM7). In some instances, the GPCR binding domains interact with an intracellular surface of the GPCR. For example, the GPCR binding domains interact with at least one intracellular loop including, but not limited to, intracellular loop 1 (ICL1), intracellular loop 2 (ICL2), and intracellular loop 3 (ICL3). In some instances, the GPCR binding domains interact with an extracellular surface of the GPCR. See FIG. 1. For example, the GPCR binding domains interact with at least one extracellular domain (ECD) or extracellular loop (ECL) of the GPCR. The extracellular loops include, but are not limited to, extracellular loop 1 (ECL1), extracellular loop 2 (ECL2), and extracellular loop 3 (ECL3).

TABLE 1

List of GPCRs

| GPCR | Gene Name | Accession Number |
|---|---|---|
| 5-hydroxytryptamine receptor 1A | HTR1A | P08908 |
| 5-hydroxytryptamine receptor 1B | HTR1B | P28222 |
| 5-hydroxytryptamine receptor 1D | HTR1D | P28221 |
| 5-hydroxytryptamine receptor 1E | HTR1E | P28566 |
| 5-hydroxytryptamine receptor 1F | HTR1F | P30939 |
| 5-hydroxytryptamine receptor 2A | HTR2A | P28223 |
| 5-hydroxytryptamine receptor 2B | HTR2B | P41595 |
| 5-hydroxytryptamine receptor 2C | HTR2C | P28335 |
| 5-hydroxytryptamine receptor 4 | HTR4 | Q13639 |
| 5-hydroxytryptamine receptor 5A | HTR5A | P47898 |
| 5-hydroxytryptamine receptor 6 | HTR6 | P50406 |
| 5-hydroxytryptamine receptor | HTR7 | P34969 |
| Adenosine receptor A1 | ADORA1 | P30542 |
| Adenosine receptor A2a | ADORA2A | P29274 |
| Adenosine receptor A2b | ADORA2B | P29275 |
| Adenosine A3 receptor | ADORA3 | P33765 |
| Muscarinic acetylcholine receptor M1 | CHRM1 | P11229 |
| Muscarinic acetylcholine receptor M2 | CHRM2 | P08172 |
| Muscarinic acetylcholine receptor M3 | CHRM3 | P20309 |
| Muscarinic acetylcholine receptor M4 | CHRM4 | P08173 |
| Muscarinic acetylcholine receptor M5 | CHRM5 | P08912 |
| Adrenocorticotropic hormone receptor | MC2R | Q01718 |
| α-1A adrenergic receptor | ADRA1A | P35348 |
| α-1B adrenergic receptor | ADRA1B | P35368 |
| α-1D adrenergic receptor | ADRA1D | P25100 |
| α-2A adrenergic receptor | ADRA2A | P08913 |
| α-2B adrenergic receptor | ADRA2B | P18089 |
| α-2C adrenergic receptor | ADRA2C | P18825 |
| β-1 adrenergic receptor | ADRB1 | P08588 |
| β-2 adrenergic receptor | ADRB2 | P07550 |
| β-3 adrenergic receptor | ADRB3 | P13945 |
| Type-1 angiotensin II receptor | AGTR1 | P30556 |
| Duffy antigen/chemokine receptor | DARC | Q16570 |
| Endothelin-1 receptor | EDNRA | P25101 |
| Endothelin B receptor | EDNRB | P24530 |
| N-formyl peptide receptor 2 | FPR2 | P25090 |
| Follicle-stimulating hormone receptor | FSHR | P23945 |
| Galanin receptor type 1 | GALR1 | P47211 |
| Galanin receptor type 2 | GALR2 | O43603 |
| Galanin receptor type 3 | GALR3 | O60755 |
| Gastrin/cholecystokinin type B receptor | CCKBR | P32239 |
| Gonadotropin-releasing hormone receptor | GNRHR | P30968 |
| Putative gonadotropin-releasing hormone II receptor | GNRHR2 | Q96P88 |
| G-protein coupled oestrogen receptor 1 | GPER | Q99527 |
| Uracil nucleotide/cysteinyl leukotriene receptor | GPR17 | Q13304 |
| Putative G-protein coupled receptor 44 | GPR44 | Q9Y5Y4 |
| G-protein coupled receptor 55 | GPR55 | Q9Y2T6 |
| Gastrin-releasing peptide receptor | GRPR | P30550 |

TABLE 1-continued

List of GPCRs

| GPCR | Gene Name | Accession Number |
|---|---|---|
| Histamine H1 receptor | HRH1 | P35367 |
| Histamine H2 receptor | HRH2 | P25021 |
| Histamine H3 receptor | HRH3 | Q9Y5N1 |
| Histamine H4 receptor | HRH4 | Q9H3N8 |
| KiSS-1 receptor | KISS1R | Q969F8 |
| Lysophosphatidic acid receptor 1 | LPAR1 | Q92633 |
| Lysophosphatidic acid receptor 2 | LPAR2 | Q9HBW0 |
| Lysophosphatidic acid receptor 3 | LPAR3 | Q9UBY5 |
| Lysophosphatidic acid receptor 4 | LPAR4 | Q99677 |
| Lysophosphatidic acid receptor 6 | LPAR6 | P43657 |
| Lutropin-choriogonadotropic hormone receptor | LHCGR | P22888 |
| Leukotriene B4 receptor 1 | LTB4R | Q15722 |
| Leukotriene B4 receptor 2 | LTB4R2 | Q9NPC1 |
| Melanocortin receptor 3 | MC3R | P41968 |
| Melanocortin receptor 4 | MC4R | P32245 |
| Melanocortin receptor 5 | MC5R | P33032 |
| Olfactory receptor 10G9 | OR10G9 | Q8NGN4 |
| Olfactory receptor 10H1 | OR10H1 | Q9Y4A9 |
| Olfactory receptor 10H2 | OR10H2 | O60403 |
| Olfactory receptor 10H3 | OR10H3 | O60404 |
| Olfactory receptor 10H4 | OR10H4 | Q8NGA5 |
| Olfactory receptor 10H5 | OR10H5 | Q8NGA6 |
| Olfactory receptor 10J1 | OR10J1 | P30954 |
| Olfactory receptor 10J3 | OR10J3 | Q5JRS4 |
| Olfactory receptor 10J5 | OR10J5 | Q8NHC4 |
| Olfactory receptor 10K1 | OR10K1 | Q8NGX5 |
| Olfactory receptor 10K2 | OR10K2 | Q6IF99 |
| Olfactory receptor 10P1 | OR10P1 | Q8NGE3 |
| Olfactory receptor 10Q1 | OR10Q1 | Q8NGQ4 |
| Olfactory receptor 10R2 | OR10R2 | Q8NGX6 |
| Olfactory receptor 10S1 | OR10S1 | Q8NGN2 |
| Olfactory receptor 10T2 | OR10T2 | Q8NGX3 |
| Olfactory receptor 10V1 | OR10V1 | Q8NGI7 |
| Olfactory receptor 10W1 | OR10W1 | Q8NGF6 |
| Olfactory receptor 14A2 | OR14A2 | Q96R54 |
| Olfactory receptor 14C36 | OR14C36 | Q8NHC7 |
| Olfactory receptor 14I1 | OR14I1 | A6ND48 |
| Olfactory receptor 14J1 | OR14J1 | Q9UGF5 |
| Olfactory receptor 14K1 | OR14K1 | Q8NGZ2 |
| Olfactory receptor 2A12 | OR2A12 | Q8NGT7 |
| Olfactory receptor 2A14 | OR2A14 | Q96R47 |
| Olfactory receptor 2A25 | OR2A25 | A4D2G3 |
| Olfactory receptor 2AG1 | OR2AG1 | Q9H205 |
| Olfactory receptor 2AG2 | OR2AG2 | A6NM03 |
| Olfactory receptor 2AJ1 | OR2AJ1 | Q8NGZ0 |
| Olfactory receptor 2AK2 | OR2AK2 | Q8NG84 |
| Olfactory receptor 2AP1 | OR2AP1 | Q8NGE2 |
| Olfactory receptor 2AT4 | OR2AT4 | A6NND4 |
| Olfactory receptor 51I2 | OR51I2 | Q9H344 |
| Olfactory receptor 51J1 | OR51J1 | Q9H342 |
| Olfactory receptor 51L1 | OR51L1 | Q8NGJ5 |
| Olfactory receptor 51M1 | OR51M1 | Q9H341 |
| Olfactory receptor 51Q1 | OR51Q1 | Q8NH59 |
| Olfactory receptor 51S1 | OR51S1 | Q8NGJ8 |
| Olfactory receptor 51T1 | OR51T1 | Q8NGJ9 |
| Olfactory receptor 51V1 | OR51V1 | Q9H2C8 |
| Olfactory receptor 52A1 | OR52A1 | Q9UKL2 |
| Olfactory receptor 52A5 | OR52A5 | Q9H2C5 |
| Olfactory receptor 52B2 | OR52B2 | Q96RD2 |
| Olfactory receptor 52B4 | OR52B4 | Q8NGK2 |
| Olfactory receptor 52B6 | OR52B6 | Q8NGF0 |
| Olfactory receptor 52D1 | OR52D1 | Q9H346 |
| Olfactory receptor 52E2 | OR52E2 | Q8NGJ4 |
| Olfactory receptor 52E4 | OR52E4 | Q8NGH9 |
| Olfactory receptor 52E5 | OR52E5 | Q8NH55 |
| Olfactory receptor 52E6 | OR52E6 | Q96RD3 |
| Olfactory receptor 52E8 | OR52E8 | Q6IFG1 |
| Olfactory receptor 52H1 | OR52H1 | Q8NGJ2 |
| Olfactory receptor 52I1 | OR52I1 | Q8NGK6 |
| Olfactory receptor 52I2 | OR52I2 | Q8NH67 |
| Olfactory receptor 52K1 | OR52K1 | Q8NGK4 |
| Olfactory receptor 52K2 | OR52K2 | Q8NGK3 |
| Olfactory receptor 52L1 | OR52L1 | Q8NGH7 |
| Olfactory receptor 52M1 | OR52M1 | Q8NGK5 |

TABLE 1-continued

List of GPCRs

| GPCR | Gene Name | Accession Number |
|---|---|---|
| Olfactory receptor 52N1 | OR52N1 | Q8NH53 |
| Olfactory receptor 52N2 | OR52N2 | Q8NGI0 |
| Olfactory receptor 52N4 | OR52N4 | Q8NGI2 |
| Olfactory receptor 52N5 | OR52N5 | Q8NH56 |
| Olfactory receptor 52R1 | OR52R1 | Q8NGF1 |
| Olfactory receptor 52W1 | OR52W1 | Q6IF63 |
| Red-sensitive opsin | OPN1LW | P04000 |
| Visual pigment-like receptor peropsin | RRH | O14718 |
| Olfactory receptor 1A1 | OR1A1 | Q9P1Q5 |
| Olfactory receptor 1A2 | OR1A2 | Q9Y585 |
| Olfactory receptor 1B1 | OR1B1 | Q8NGR6 |
| Olfactory receptor 1C1 | OR1C1 | Q15619 |
| Olfactory receptor 1D2 | OR1D2 | P34982 |
| Olfactory receptor 1F1 | OR1F1 | O43749 |
| Olfactory receptor 1F12 | OR1F12 | Q8NHA8 |
| Olfactory receptor 1G1 | OR1G1 | P47890 |
| Olfactory receptor 1I1 | OR1I1 | O60431 |
| Olfactory receptor 1J1 | OR1J1 | Q8NGS3 |
| Olfactory receptor 1J2 | OR1J2 | Q8NGS2 |
| Olfactory receptor 1J4 | OR1J4 | Q8NGS1 |
| Olfactory receptor 1K1 | OR1K1 | Q8NGR3 |
| Olfactory receptor 1L1 | OR1L1 | Q8NH94 |
| Olfactory receptor 1L3 | OR1L3 | Q8NH93 |
| Olfactory receptor 1L4 | OR1L4 | Q8NGR5 |
| Olfactory receptor 1L6 | OR1L6 | Q8NGR2 |
| Olfactory receptor 1L8 | OR1L8 | Q8NGR8 |
| Olfactory receptor 1M1 | OR1M1 | Q8NGA1 |
| Olfactory receptor 1N1 | OR1N1 | Q8NGS0 |
| Olfactory receptor 1N2 | OR1N2 | Q8NGR9 |
| Olfactory receptor 1Q1 | OR1Q1 | Q15612 |
| Olfactory receptor 1S1 | OR1S1 | Q8NH92 |
| Olfactory receptor 1S2 | OR1S2 | Q8NGQ3 |
| Olfactory receptor 2A2 | OR2A2 | Q6IF42 |
| Olfactory receptor 2A4 | OR2A4 | O95047 |
| Olfactory receptor 2B2 | OR2B2 | Q9GZK3 |
| Putative olfactory receptor 2B3 | OR2B3 | O76000 |
| Olfactory receptor 2B6 | OR2B6 | P58173 |
| Putative olfactory receptor 2B8 | OR2B8P | P59922 |
| Olfactory receptor 2T5 | OR2T5 | Q6IEZ7 |
| Olfactory receptor 2T6 | OR2T6 | Q8NHC8 |
| Olfactory receptor 2T8 | OR2T8 | A6NH00 |
| Olfactory receptor 2V1 | OR2V1 | Q8NHB1 |
| Olfactory receptor 2V2 | OR2V2 | Q96R30 |
| Olfactory receptor 2W1 | OR2W1 | Q9Y3N9 |
| Olfactory receptor 2W3 | OR2W3 | Q7Z3T1 |
| Olfactory receptor 2Y1 | OR2Y1 | Q8NGV0 |
| Olfactory receptor 2Z1 | OR2Z1 | Q8NG97 |
| Olfactory receptor 3A1 | OR3A1 | P47881 |
| Olfactory receptor 3A2 | OR3A2 | P47893 |
| Olfactory receptor 3A3 | OR3A3 | P47888 |
| Olfactory receptor 3A4 | OR3A4 | P47883 |
| Putative olfactory receptor 4A4 | OR4A4P | Q8NGN8 |
| Olfactory receptor 4A5 | OR4A5 | Q8NH83 |
| Olfactory receptor 4A8 | OR4A8P | P0C604 |
| Olfactory receptor 4B1 | OR4B1 | Q8NGF8 |
| Olfactory receptor 4C3 | OR4C3 | Q8NH37 |
| Olfactory receptor 4C5 | OR4C5 | Q8NGB2 |
| Olfactory receptor 4C6 | OR4C6 | Q8NH72 |
| Olfactory receptor 4C11 | OR4C11 | Q6IEV9 |
| Olfactory receptor 4C12 | OR4C12 | Q96R67 |
| Olfactory receptor 4C13 | OR4C13 | Q8NGP0 |
| Olfactory receptor 4C15 | OR4C15 | Q8NGM1 |
| Olfactory receptor 4C16 | OR4C16 | Q8NGL9 |
| Olfactory receptor 4D1 | OR4D1 | Q15615 |
| Olfactory receptor 4D2 | OR4D2 | P58180 |
| Olfactory receptor 4D5 | OR4D5 | Q8NGN0 |
| Olfactory receptor 4D6 | OR4D6 | Q8NGJ1 |
| Olfactory receptor 4D9 | OR4D9 | Q8NGE8 |
| Olfactory receptor 4D10 | OR4D10 | Q8NGI6 |
| Olfactory receptor 4D11 | OR4D11 | Q8NGI4 |
| Olfactory receptor 5B17 | OR5B17 | Q8NGF7 |
| Olfactory receptor 5B21 | OR5B21 | A6NL26 |
| Olfactory receptor 5C1 | OR5C1 | Q8NGR4 |
| Olfactory receptor 5D13 | OR5D13 | Q8NGL4 |
| Olfactory receptor 5D14 | OR5D14 | Q8NGL3 |
| Olfactory receptor 5D16 | OR5D16 | Q8NGK9 |
| Olfactory receptor 5D18 | OR5D18 | Q8NGL1 |
| Olfactory receptor 5F1 | OR5F1 | O95221 |
| Olfactory receptor 5H1 | OR5H1 | A6NKK0 |
| Olfactory receptor 5H2 | OR5H2 | Q8NGV7 |
| Olfactory receptor 5H6 | OR5H6 | Q8NGV6 |
| Olfactory receptor 5I1 | OR5I1 | Q13606 |
| Olfactory receptor 5J2 | OR5J2 | Q8NH18 |
| Olfactory receptor 5K1 | OR5K1 | Q8NHB7 |
| Olfactory receptor 5K2 | OR5K2 | Q8NHB8 |
| Olfactory receptor 5K3 | OR5K3 | A6NET4 |
| Olfactory receptor 5K4 | OR5K4 | A6NMS3 |
| Olfactory receptor 5L1 | OR5L1 | Q8NGL2 |
| Olfactory receptor 5L2 | OR5L2 | Q8NGL0 |
| Olfactory receptor 5M1 | OR5M1 | Q8NGP8 |
| Olfactory receptor 5M3 | OR5M3 | Q8NGP4 |
| Olfactory receptor 5M8 | OR5M8 | Q8NGP6 |
| Olfactory receptor 5M9 | OR5M9 | Q8NGP3 |
| Olfactory receptor 5M10 | OR5M10 | Q6IEU7 |
| Olfactory receptor 5M11 | OR5M11 | Q96RB7 |
| Olfactory receptor 5P2 | OR5P2 | Q8WZ92 |
| Olfactory receptor 5P3 | OR5P3 | Q8WZ94 |
| Olfactory receptor 5R1 | OR5R1 | Q8NH85 |
| Olfactory receptor 5T1 | OR5T1 | Q8NG75 |
| Olfactory receptor 5T2 | OR5T2 | Q8NGG2 |
| Olfactory receptor 5T3 | OR5T3 | Q8NGG3 |
| Olfactory receptor 5W2 | OR5W2 | Q8NH69 |
| Olfactory receptor 7G3 | OR7G3 | Q8NG95 |
| Olfactory receptor 8A1 | OR8A1 | Q8NGG7 |
| Olfactory receptor 8B3 | OR8B3 | Q8NGG8 |
| Olfactory receptor 8B4 | OR8B4 | Q96RC9 |
| Olfactory receptor 8B8 | OR8B8 | Q15620 |
| Olfactory receptor 8B12 | OR8B12 | Q8NGG6 |
| Olfactory receptor 8D1 | OR8D1 | Q8WZ84 |
| Olfactory receptor 8D2 | OR8D2 | Q9GZM6 |
| Olfactory receptor 8D4 | OR8D4 | Q8NGM9 |
| Orexin receptor type 1 | HCRTR1 | O43613 |
| Orexin receptor type 2 | HCRTR2 | O43614 |
| Oxoeicosanoid receptor 1 | OXER1 | Q8TDS5 |
| Oxytocin receptor | OXTR | P30559 |
| P2Y purinoceptor 1 | P2RY1 | P47900 |
| P2Y purinoceptor 2 | P2RY2 | P41231 |
| P2Y purinoceptor 4 | P2RY4 | P51582 |
| P2Y purinoceptor 6 | P2RY6 | Q15077 |
| P2Y purinoceptor 8 | P2RY8 | Q86VZ1 |
| Putative P2Y purinoceptor 10 | P2RY10 | O00398 |
| P2Y purinoceptor 11 | P2RY11 | Q96G91 |
| P2Y purinoceptor 12 | P2RY12 | Q9H244 |
| P2Y purinoceptor 13 | P2RY13 | Q9BPV8 |
| P2Y purinoceptor 14 | P2RY14 | Q15391 |
| Proteinase-activated receptor 1 | F2R | P25116 |
| Proteinase-activated receptor 2 | F2RL1 | P55085 |
| Proteinase-activated receptor 3 | F2RL2 | O00254 |
| Proteinase-activated receptor 4 | F2RL3 | Q96RI0 |
| Prostaglandin D2 receptor | PTGDR | Q13258 |
| Prostaglandin E2 receptor EP1 subtype | PTGER1 | P34995 |
| Prostaglandin E2 receptor EP2 subtype | PTGER2 | P43116 |
| Prostaglandin E2 receptor EP3 subtype | PTGER3 | P43115 |
| Prostaglandin E2 receptor EP4 subtype | PTGER4 | P35408 |
| Type-2 angiotensin II receptor (AT2) | AGTR2 | P50052 |
| Apelin receptor | APLNR | P35414 |
| B1 bradykinin receptor | BDKRB1 | P46663 |
| B2 bradykinin receptor | BDKRB2 | P30411 |
| C5a anaphylatoxin chemotactic receptor | C5AR1 | P21730 |
| Cholecystokinin receptor type A | CCKAR | P32238 |
| C-C chemokine receptor type 10 | CCR10 | P46092 |
| C-C chemokine receptor type 1 | CCR1 | P32246 |
| C-C chemokine receptor type 2 | CCR2 | P41597 |
| C-C chemokine receptor type 3 | CCR3 | P51677 |
| C-C chemokine receptor type 4 | CCR4 | P51679 |
| C-C chemokine receptor type 5 | CCR5 | P51681 |
| C-C chemokine receptor type 6 | CCR6 | P51684 |
| C-C chemokine receptor type 7 | CCR7 | P32248 |
| C-C chemokine receptor type 8 | CCR8 | P51685 |
| C-C chemokine receptor type 9 | CCR9 | P51686 |

TABLE 1-continued

List of GPCRs

| GPCR | Gene Name | Accession Number |
|---|---|---|
| Cysteinyl leukotriene receptor 1 | CYSLTR1 | Q9Y271 |
| Cysteinyl leukotriene receptor 2 | CYSLTR2 | Q9NS75 |
| Cannabinoid receptor 1 | CNR1 | P21554 |
| Cannabinoid receptor 2 | CNR2 | P34972 |
| CX3C chemokine receptor 1 | CX3CR1 | P49238 |
| High affinity interleukin-8 receptor A | IL8RA | P25024 |
| High affinity interleukin-8 receptor B | IL8RB | P25025 |
| C-X-C chemokine receptor type 3 | CXCR3 | P49682 |
| C-X-C chemokine receptor type 4 | CXCR4 | P61073 |
| C-X-C chemokine receptor type 6 | CXCR6 | O00574 |
| C-X-C chemokine receptor type 7 | CXCR7 | P25106 |
| D(1A) dopamine receptor | DRD1 | P21728 |
| D(2) dopamine receptor | DRD2 | P14416 |
| D(3) dopamine receptor | DRD3 | P35462 |
| D(4) dopamine receptor | DRD4 | P21917 |
| D(1B) dopamine receptor | DRD5 | P21918 |
| Melanocyte-stimulating hormone receptor | MC1R | Q01726 |
| Melatonin receptor type 1A | MTNR1A | P48039 |
| Melatonin receptor type 1B | MTNR1B | P49286 |
| Substance-P receptor | TACR1 | P25103 |
| Substance-K receptor | TACR2 | P21452 |
| Neuromedin-K receptor | TACR3 | P29371 |
| Neuromedin-B receptor | NMBR | P28336 |
| Neuropeptides B/W receptor type 1 | NPBWR1 | P48145 |
| Neuropeptides B/W receptor type 2 | NPBWR2 | P48146 |
| Neuropeptide FF receptor 1 | NPFFR1 | Q9GZQ6 |
| Neuropeptide FF receptor 2 | NPFFR2 | Q9Y5X5 |
| Neuropeptide Y receptor type 1 | NPY1R | P25929 |
| Neuropeptide Y receptor type 2 | NPY2R | P49146 |
| Neuropeptide Y receptor type 4 | PPYR1 | P50391 |
| Neuropeptide Y receptor type 5 | NPY5R | Q15761 |
| Neurotensin receptor type 1 | NTSR1 | P30989 |
| Neurotensin receptor type 2 | NTSR2 | O95665 |
| Olfactory receptor 10A2 | OR10A2 | Q9H208 |
| Olfactory receptor 10A3 | OR10A3 | P58181 |
| Olfactory receptor 10A4 | OR10A4 | Q9H209 |
| Olfactory receptor 10A5 | OR10A5 | Q9H207 |
| Olfactory receptor 10A6 | OR10A6 | Q8NH74 |
| Olfactory receptor 10A7 | OR10A7 | Q8NGE5 |
| Olfactory receptor 10AD1 | OR10AD1 | Q8NGE0 |
| Olfactory receptor 10AG1 | OR10AG1 | Q8NH19 |
| Olfactory receptor 10C1 | OR10C1 | Q96KK4 |
| Olfactory receptor 10G2 | OR10G2 | Q8NGC3 |
| Olfactory receptor 10G3 | OR10G3 | Q8NGC4 |
| Olfactory receptor 10G4 | OR10G4 | Q8NGN3 |
| Olfactory receptor 10G6 | OR10G6 | Q8NH81 |
| Olfactory receptor 10G7 | OR10G7 | Q8NGN6 |
| Olfactory receptor 10G8 | OR10G8 | Q8NGN5 |
| Olfactory receptor 2T10 | OR2T10 | Q8NGZ9 |
| Olfactory receptor 2T11 | OR2T11 | Q8NH01 |
| Olfactory receptor 2T12 | OR2T12 | Q8NG77 |
| Olfactory receptor 2T27 | OR2T27 | Q8NH04 |
| Olfactory receptor 2T29 | OR2T29 | Q8NH02 |
| Olfactory receptor 2T33 | OR2T33 | Q8NG76 |
| Olfactory receptor 2T34 | OR2T34 | Q8NGX1 |
| Olfactory receptor 2T35 | OR2T35 | Q8NGX2 |
| Olfactory receptor 4A15 | OR4A15 | Q8NGL6 |
| Olfactory receptor 4A16 | OR4A16 | Q8NH70 |
| Olfactory receptor 4A47 | OR4A47 | Q6IF82 |
| Olfactory receptor 4C45 | OR4C45 | A6NMZ5 |
| Olfactory receptor 4C46 | OR4C46 | A6NHA9 |
| Olfactory receptor 4F15 | OR4F15 | Q8NGB8 |
| Olfactory receptor 4F17 | OR4F17 | Q8NGA8 |
| Olfactory receptor 4F21 | OR4F21 | O95013 |
| Olfactory receptor 51A2 | OR51A2 | Q8NGJ7 |
| Olfactory receptor 51A4 | OR51A4 | Q8NGJ6 |
| Olfactory receptor 51A7 | OR51A7 | Q8NH64 |
| Olfactory receptor 51B2 | OR51B2 | Q9Y5P1 |
| Olfactory receptor 51B4 | OR51B4 | Q9Y5P0 |
| Olfactory receptor 51B5 | OR51B5 | Q9H339 |
| Olfactory receptor 51B5 | OR51B6 | Q9H340 |
| Olfactory receptor 51D1 | OR51D1 | Q8NGF3 |
| Olfactory receptor 51E1 | OR51E1 | Q8TCB6 |
| Olfactory receptor 51E2 | OR51E2 | Q9H255 |
| Olfactory receptor 51F1 | OR51F1 | A6NGY5 |
| Olfactory receptor 51F2 | OR51F2 | Q8NH61 |
| Olfactory receptor 51G1 | OR51G1 | Q8NGK1 |
| Olfactory receptor 51G2 | OR51G2 | Q8NGK0 |
| Putative olfactory receptor 51H1 | OR51H1P | Q8NH63 |
| Olfactory receptor 51I1 | OR51I1 | Q9H343 |
| Olfactory receptor 56A1 | OR56A1 | Q8NGH5 |
| Olfactory receptor 56A3 | OR56A3 | Q8NH54 |
| Olfactory receptor 56A4 | OR56A4 | Q8NGH8 |
| Olfactory receptor 56A5 | OR56A5 | P0C7T3 |
| Olfactory receptor 56B1 | OR56B1 | Q8NGI3 |
| Olfactory receptor 56B4 | OR56B4 | Q8NH76 |
| Olfactory receptor 5AC2 | OR5AC2 | Q9NZP5 |
| Olfactory receptor 5AK2 | OR5AK2 | Q8NH90 |
| Olfactory receptor 5AN1 | OR5AN1 | Q8NGI8 |
| Olfactory receptor 5AP2 | OR5AP2 | Q8NGF4 |
| Olfactory receptor 5AR1 | OR5AR1 | Q8NGP9 |
| Olfactory receptor 5AS1 | OR5AS1 | Q8N127 |
| Olfactory receptor 5AU1 | OR5AU1 | Q8NGC0 |
| Olfactory receptor 5H14 | OR5H14 | A6NHG9 |
| Olfactory receptor 5H15 | OR5H15 | A6NDH6 |
| Olfactory receptor 6C65 | OR6C65 | A6NJZ3 |
| Olfactory receptor 6C68 | OR6C68 | A6NDL8 |
| Olfactory receptor 6C70 | OR6C70 | A6NIJ9 |
| Olfactory receptor 6C74 | OR6C74 | A6NCV1 |
| Olfactory receptor 6C75 | OR6C75 | A6NL08 |
| Olfactory receptor 6C76 | OR6C76 | A6NM76 |
| Olfactory receptor 7E24 | OR7E24 | Q6IFN5 |
| Opsin-3 | OPN3 | Q9H1Y3 |
| Melanopsin | OPN4 | Q9UHM6 |
| Opsin-5 | OPN5 | Q6U736 |
| δ-type opioid receptor | OPRD1 | P41143 |
| κ-type opioid receptor | OPRK1 | P41145 |
| μ-type opioid receptor | OPRM1 | P35372 |
| Nociceptin receptor | OPRL1 | P41146 |
| Blue-sensitive opsin | OPN1SW | P03999 |
| Rhodopsin | RHO | P08100 |
| Green-sensitive opsin | OPN1MW | P04001 |
| Olfactory receptor 2B11 | OR2B11 | Q5JQS5 |
| Olfactory receptor 2C1 | OR2C1 | O95371 |
| Olfactory receptor 2C3 | OR2C3 | Q8N628 |
| Olfactory receptor 2D2 | OR2D2 | Q9H210 |
| Olfactory receptor 2D3 | OR2D3 | Q8NGH3 |
| Olfactory receptor 2F1 | OR2F1 | Q13607 |
| Olfactory receptor 2F2 | OR2F2 | O95006 |
| Olfactory receptor 2G2 | OR2G2 | Q8NGZ5 |
| Olfactory receptor 2G3 | OR2G3 | Q8NGZ4 |
| Olfactory receptor 2G6 | OR2G6 | Q5TZ20 |
| Olfactory receptor 2H1 | OR2H1 | Q9GZK4 |
| Olfactory receptor 2H2 | OR2H2 | O95918 |
| Putative olfactory receptor 2I1 | OR2I1P | Q8NGU4 |
| Olfactory receptor 2J1 | OR2J1 | Q9GZK6 |
| Olfactory receptor 2J2 | OR2J2 | O76002 |
| Olfactory receptor 2J3 | OR2J3 | O76001 |
| Olfactory receptor 2K2 | OR2K2 | Q8NGT1 |
| Olfactory receptor 2L2 | OR2L2 | Q8NH16 |
| Olfactory receptor 2L3 | OR2L3 | Q8NG85 |
| Olfactory receptor 2L5 | OR2L5 | Q8NG80 |
| Olfactory receptor 2L8 | OR2L8 | Q8NGY9 |
| Olfactory receptor 2L13 | OR2L13 | Q8N349 |
| Olfactory receptor 2M2 | OR2M2 | Q96R28 |
| Olfactory receptor 2M3 | OR2M3 | Q8NG83 |
| Olfactory receptor 2M4 | OR2M4 | Q96R27 |
| Olfactory receptor 2M5 | OR2M5 | A3KFT3 |
| Olfactory receptor 2M7 | OR2M7 | Q8NG81 |
| Olfactory receptor 2S2 | OR2S2 | Q9NQN1 |
| Olfactory receptor 2T1 | OR2T1 | O43869 |
| Olfactory receptor 2T2 | OR2T2 | Q6IF00 |
| Olfactory receptor 2T3 | OR2T3 | Q8NH03 |
| Olfactory receptor 2T4 | OR2T4 | Q8NH00 |
| Olfactory receptor 4E1 | OR4E1 | P0C645 |
| Olfactory receptor 4E2 | OR4E2 | Q8NGC2 |
| Olfactory receptor 4F3/4F16/4F29 | OR4F3 | Q6IEY1 |
| Olfactory receptor 4F4 | OR4F4 | Q96R69 |
| Olfactory receptor 4F5 | OR4F5 | Q8NH21 |
| Olfactory receptor 4F6 | OR4F6 | Q8NGB9 |

TABLE 1-continued

List of GPCRs

| GPCR | Gene Name | Accession Number |
|---|---|---|
| Olfactory receptor 4K1 | OR4K1 | Q8NGD4 |
| Olfactory receptor 4K2 | OR4K2 | Q8NGD2 |
| Olfactory receptor 4K3 | OR4K3 | Q96R72 |
| Olfactory receptor 4K5 | OR4K5 | Q8NGD3 |
| Olfactory receptor 4K13 | OR4K13 | Q8NH42 |
| Olfactory receptor 4K14 | OR4K14 | Q8NGD5 |
| Olfactory receptor 4K15 | OR4K15 | Q8NH41 |
| Olfactory receptor 4K17 | OR4K17 | Q8NGC6 |
| Olfactory receptor 4L1 | OR4L1 | Q8NH43 |
| Olfactory receptor 4M1 | OR4M1 | Q8NGD0 |
| Olfactory receptor 4M2 | OR4M2 | Q8NGB6 |
| Olfactory receptor 4N2 | OR4N2 | Q8NGD1 |
| Olfactory receptor 4N4 | OR4N4 | Q8N0Y3 |
| Olfactory receptor 4N5 | OR4N5 | Q8IXE1 |
| Olfactory receptor 4P4 | OR4P4 | Q8NGL7 |
| Olfactory receptor 4Q2 | OR4Q2 | P0C623 |
| Olfactory receptor 4Q3 | OR4Q3 | Q8NH05 |
| Olfactory receptor 4S1 | OR4S1 | Q8NGB4 |
| Olfactory receptor 4S2 | OR4S2 | Q8NH73 |
| Olfactory receptor 4X1 | OR4X1 | Q8NH49 |
| Olfactory receptor 4X2 | OR4X2 | Q8NGF9 |
| Olfactory receptor 5A1 | OR5A1 | Q8NGJ0 |
| Olfactory receptor 5A2 | OR5A2 | Q8NGI9 |
| Olfactory receptor 5B2 | OR5B2 | Q96R09 |
| Olfactory receptor 5B3 | OR5B3 | Q8NH48 |
| Olfactory receptor 5B12 | OR5B12 | Q96R08 |
| Olfactory receptor 6A2 | OR6A2 | O95222 |
| Olfactory receptor 6B1 | OR6B1 | O95007 |
| Olfactory receptor 6B2 | OR6B2 | Q6IFH4 |
| Olfactory receptor 6B3 | OR6B3 | Q8NGW1 |
| Olfactory receptor 6C1 | OR6C1 | Q96RD1 |
| Olfactory receptor 6C2 | OR6C2 | Q9NZP2 |
| Olfactory receptor 6C3 | OR6C3 | Q9NZP0 |
| Olfactory receptor 6C4 | OR6C4 | Q8NGE1 |
| Olfactory receptor 6C6 | OR6C6 | A6NF89 |
| Olfactory receptor 6F1 | OR6F1 | Q8NGZ6 |
| Olfactory receptor 6J1 | OR6J1 | Q8NGC5 |
| Olfactory receptor 6K2 | OR6K2 | Q8NGY2 |
| Olfactory receptor 6K3 | OR6K3 | Q8NGY3 |
| Olfactory receptor 6K6 | OR6K6 | Q8NGW6 |
| Olfactory receptor 6M1 | OR6M1 | Q8NGM8 |
| Olfactory receptor 6N1 | OR6N1 | Q8NGY5 |
| Olfactory receptor 6N2 | OR6N2 | Q8NGY6 |
| Olfactory receptor 6P1 | OR6P1 | Q8NGX9 |
| Olfactory receptor 6Q1 | OR6Q1 | Q8NGQ2 |
| Olfactory receptor 6S1 | OR6S1 | Q8NH40 |
| Olfactory receptor 6T1 | OR6T1 | Q8NGN1 |
| Olfactory receptor 6V1 | OR6V1 | Q8N148 |
| Olfactory receptor 6X1 | OR6X1 | Q8NH79 |
| Olfactory receptor 6Y1 | OR6Y1 | Q8NGX8 |
| Olfactory receptor 7A5 | OR7A5 | Q15622 |
| Olfactory receptor 7A10 | OR7A10 | O76100 |
| Olfactory receptor 7A17 | OR7A17 | O14581 |
| Olfactory receptor 7C1 | OR7C1 | O76099 |
| Olfactory receptor 7C2 | OR7C2 | O60412 |
| Olfactory receptor 7D4 | OR7D4 | Q8NG98 |
| Olfactory receptor 7G1 | OR7G1 | Q8NGA0 |
| Olfactory receptor 7G2 | OR7G2 | Q8NG99 |
| Prostaglandin F2-α receptor | PTGFR | P43088 |
| Prostacyclin receptor | PTGIR | P43119 |
| Prolactin-releasing peptide receptor | PRLHR | P49683 |
| Platelet-activating factor receptor | PTAFR | P25105 |
| Pyroglutamylated RFamide peptide receptor | QRFPR | Q96P65 |
| RPE-retinal G protein-coupled receptor | RGR | P47804 |
| Sphingosine 1-phosphate receptor 1 | S1PR1 | P21453 |
| Sphingosine 1-phosphate receptor 2 | S1PR2 | O95136 |
| Sphingosine 1-phosphate receptor 3 | S1PR3 | Q99500 |
| Sphingosine 1-phosphate receptor 4 | S1PR4 | O95977 |
| Sphingosine 1-phosphate receptor 5 | S1PR5 | Q9H228 |
| Somatostatin receptor type 1 | SSTR1 | P30872 |
| Somatostatin receptor type 2 | SSTR2 | P30874 |
| Somatostatin receptor type 3 | SSTR3 | P32745 |
| Somatostatin receptor type 4 | SSTR4 | P31391 |
| Somatostatin receptor type 5 | SSTR5 | P35346 |
| Thromboxane A2 receptor | TBXA2R | P21731 |
| Trace amine-associated receptor 1 | TAAR1 | Q96RJ0 |
| Trace amine-associated receptor 2 | TAAR2 | Q9P1P5 |
| Putative trace amine-associated receptor 3 | TAAR3 | Q9P1P4 |
| Trace amine-associated receptor 5 | TAAR5 | O14804 |
| Trace amine-associated receptor 6 | TAAR6 | Q96RI8 |
| Trace amine-associated receptor 8 | TAAR8 | Q969N4 |
| Trace amine-associated receptor 9 | TAAR9 | Q96RI9 |
| Thyrotropin receptor | TSHR | P16473 |
| Vasopressin V1a receptor | AVPR1A | P37288 |
| Vasopressin V1b receptor | AVPR1B | P47901 |
| Vasopressin V2 receptor | AVPR2 | P30518 |
| Chemokine XC receptor 1 | XCR1 | P46094 |
| Brain-specific angiogenesis inhibitor 1 | BAI1 | O14514 |
| Brain-specific angiogenesis inhibitor 2 | BAI2 | O60241 |
| Brain-specific angiogenesis inhibitor 3 | BAI3 | O60242 |
| Calcitonin receptor | CALCR | P30988 |
| Calcitonin gene-related peptide type 1 receptor | CALCRL | Q16602 |
| Corticotropin-releasing factor receptor 1 | CRHR1 | P34998 |
| Corticotropin-releasing factor receptor 2 | CRHR2 | Q13324 |
| Growth hormone-releasing hormone receptor | GHRHR | Q02643 |
| Gastric inhibitory polypeptide receptor | GIPR | P48546 |
| Glucagon-like peptide 1 receptor | GLP1R | P43220 |
| Glucagon-like peptide 2 receptor | GLP2R | O95838 |
| Glucagon receptor | GCGR | P47871 |
| Pituitary adenylate cyclase-activating polypeptide type I receptor | ADCYAP1R1 | P41586 |
| Taste receptor 1 member 2 | TAS1R2 | Q8TE23 |
| Parathyroid hormone receptor 1 | PTH1R | Q03431 |
| Parathyroid hormone 2 receptor | PTH2R | P49190 |
| Secretin receptor | SCTR | P47872 |
| Vasoactive intestinal polypeptide receptor 1 | VIPR1 | P32241 |
| Vasoactive intestinal polypeptide receptor 2 | VIPR2 | P41587 |
| Frizzled-10 | FZD10 | Q9ULW2 |
| Frizzled-1 | FZD1 | Q9UP38 |
| Frizzled-2 | FZD2 | Q14332 |
| Frizzled-3 | FZD3 | Q9NPG1 |
| Frizzled-4 | FZD4 | Q9ULV1 |
| Frizzled-5 | FZD5 | Q13467 |
| Frizzled-6 | FZD6 | O60353 |
| Frizzled-7 | FZD7 | O75084 |
| Frizzled-8 | FZD8 | Q9H461 |
| Frizzled-9 | FZD9 (FZD3) | O00144 |
| Smoothened homologue | SMO (SMOH) | Q99835 |
| Extracellular calcium-sensing receptor | CASR | P41180 |
| GABA type B receptor 1subunit 1 | GABBR1 | Q9UBS5 |
| GABA type B receptor subunit 2 | GABBR2 | O75899 |
| GPCR family C group 6 member A | GPRC6A | Q5T6X5 |
| Metabotropic glutamate receptor 1 | GRM1 | Q13255 |
| Metabotropic glutamate receptor 2 | GRM2 | Q14416 |
| Metabotropic glutamate receptor 3 | GRM3 | Q14832 |
| Metabotropic glutamate receptor 4 | GRM4 | Q14833 |
| Metabotropic glutamate receptor 5 | GRM5 | P41594 |
| Metabotropic glutamate receptor 6 | GRM6 | O15303 |
| Metabotropic glutamate receptor 7 | GRM7 | Q14831 |
| Metabotropic glutamate receptor 8 | GRM8 | O00222 |
| Taste receptor 1 member 1 | TAS1R1 | Q7RTX1 |
| Taste receptor 1 member 2 | TAS1R2 | Q8TE23 |
| Taste receptor 1 member 3 | TAS1R3 | Q7RTX0 |

Described herein are GPCR binding domains, wherein the GPCR binding domains are designed based on surface interactions between a GPCR ligand and the GPCR. In some instances, the ligand is a subatomic particle (e.g., a photon), an ion, an organic molecule, a peptide, and a protein. Non-limiting examples of ligands which can be bound by a GPCR include (−)-adrenaline, (−)-noradrenaline, (lyso) phospholipid mediators, [des-Arg10]kallidin, [des-Arg9] bradykinin, [des-Gln14]ghrelin, [Hyp3]bradykinin, [Leu] enkephalin, [Met]enkephalin, 12-hydroxyheptadecatrienoic acid, 12R-HETE, 12S-HETE, 12S-HPETE, 15S-HETE, 17β-estradiol, 20-hydroxy-LTB4, 2-arachidonoylglycerol, 2-oleoyl-LPA, 3-hydroxyoctanoic acid, 5-hydroxytryptamine, 5-oxo-15-HETE, 5-oxo-ETE, 5-oxo-ETrE, 5-oxo-ODE, 5S-HETE, 5S-HPETE, 7α,25-dihydroxycholesterol, acetylcholine, ACTH, adenosine diphosphate, adenosine, adrenomedullin 2/intermedin, adrenomedullin, amylin, anandamide, angiotensin II, angiotensin III, annexin I, apelin receptor early endogenous ligand, apelin-13, apelin-17, apelin-36, aspirin triggered lipoxin A4, aspirin-triggered resolvin D1, ATP, beta-defensin 4A, big dynorphin, bovine adrenal medulla peptide 8-22, bradykinin, C3a, C5a, Ca2+, calcitonin gene related peptide, calcitonin, cathepsin G, CCK-33, CCK-4, CCK-8, CCL1, CCL11, CCL13, CCL14, CCL15, CCL16, CCL17, CCL19, CCL2, CCL20, CCL21, CCL22, CCL23, CCL24, CCL25, CCL26, CCL27, CCL28, CCL3, CCL4, CCL5, CCL7, CCL8, chemerin, chenodeoxycholic acid, cholic acid, corticotrophin-releasing hormone, CST-17, CX3CL1, CXCL1, CXCL10, CXCL11, CXCL12α, CXCL12β, CXCL13, CXCL16, CXCL2, CXCL3, CXCLS, CXCL6, CXCL7, CXCL8, CXCL9, cysteinyl-leukotrienes (CysLTs), uracil nucleotides, deoxycholic acid, dihydrosphingosine-1-phosphate, dioleoylphosphatidic acid, dopamine, dynorphin A, dynorphin A-(1-13), dynorphin A-(1-8), dynorphin B, endomorphin-1, endothelin-1, endothelin-2, endothelin-3, F2L, Free fatty acids, FSH, GABA, galanin, galanin-like peptide, gastric inhibitory polypeptide, gastrin-17, gastrin-releasing peptide, ghrelin, GHRH, glucagon, glucagon-like peptide 1-(7-36) amide, glucagon-like peptide 1-(7-37), glucagon-like peptide 2, glucagon-like peptide 2-(3-33), GnRH I, GnRH II, GRP-(18-27), hCG, histamine, humanin, INSL3, INSL5, kallidin, kisspeptin-10, kisspeptin-13, kisspeptin-14, kisspeptin-54, kynurenic acid, large neuromedin N, large neurotensin, L-glutamic acid, LH, lithocholic acid, L-lactic acid, long chain carboxylic acids, LPA, LTB4, LTC4, LTD4, LTE4, LXA4, Lys-[Hyp3]-bradykinin, lysophosphatidylinositol, lysophosphatidylserine, Medium-chain-length fatty acids, melanin-concentrating hormone, melatonin, methylcarbamyl PAF, Mg2+, motilin, N-arachidonoylglycine, neurokinin A, neurokinin B, neuromedin B, neuromedin N, neuromedin S-33, neuromedin U-25, neuronostatin, neuropeptide AF, neuropeptide B-23, neuropeptide B-29, neuropeptide FF, neuropeptide S, neuropeptide SF, neuropeptide W-23, neuropeptide W-30, neuropeptide Y, neuropeptide Y-(3-36), neurotensin, nociceptin/orphanin FQ, N-oleoylethanolamide, obestatin, octopamine, orexin-A, orexin-B, Oxysterols, oxytocin, PACAP-27, PACAP-38, PAF, pancreatic polypeptide, peptide YY, PGD2, PGE2, PGF2a, PGI2, PGJ2, PHM, phosphatidylserine, PHV, prokineticin-1, prokineticin-2, prokineticin-20, prosaposin, PrRP-20, PrRP-31, PTH, PTHrP, PTHrP-(1-36), QRFP43, relaxin, relaxin-1, relaxin-3, resolvin D1, resolvin E1, RFRP-1, RFRP-3, R-spondins, secretin, serine proteases, sphingosine 1-phosphate, sphingosylphosphorylcholine, SRIF-14, SRIF-28, substance P, succinic acid, thrombin, thromboxane A2, TIP39, T-kinin, TRH, TSH, tyramine, UDP-glucose, uridine diphosphate, urocortin 1, urocortin 2, urocortin 3, urotensin II-related peptide, urotensin-II, vasopressin, VIP, Wnt, Wnt-1, Wnt-10a, Wnt-10b, Wnt-11, Wnt-16, Wnt-2, Wnt-2b, Wnt-3, Wnt-3a, Wnt-4, Wnt-5a, Wnt-5b, Wnt-6, Wnt-7a, Wnt-7b, Wnt-8a, Wnt-8b, Wnt-9a, Wnt-9b, XCL1, XCL2, Zn2+, α-CGRP, α-ketoglutaric acid, α-MSH, α-neoendorphin, β-alanine, β-CGRP, β-D-hydroxybutyric acid, β-endorphin, β-MSH, β-neoendorphin, β-phenylethylamine, and γ-MSH.

Sequences of GPCR binding domains based on surface interactions between a GPCR ligand and the GPCR are analyzed using various methods. For example, multispecies computational analysis is performed. In some instances, a structure analysis is performed. In some instances, a sequence analysis is performed. Sequence analysis can be performed using a database known in the art. Non-limiting examples of databases include, but are not limited to, NCBI BLAST (blast.ncbi.nlm.nih.gov/Blast.cgi), UCSC Genome Browser (genome.ucsc.edu/), UniProt (www.uniprot.org/), and IUPHAR/BPS Guide to PHARMACOLOGY (guidetopharmacology.org/).

Described herein are GPCR binding domains designed based on sequence analysis among various organisms. For example, sequence analysis is performed to identify homologous sequences in different organisms. Exemplary organisms include, but are not limited to, mouse, rat, equine, sheep, cow, primate (e.g., chimpanzee, baboon, gorilla, orangutan, monkey), dog, cat, pig, donkey, rabbit, fish, fly, and human.

Following identification of GPCR binding domains, libraries comprising nucleic acids encoding for the GPCR binding domains may be generated. In some instances, libraries of GPCR binding domains comprise sequences of GPCR binding domains designed based on conformational ligand interactions, peptide ligand interactions, small molecule ligand interactions, extracellular domains of GPCRs, or antibodies that target GPCRs. Libraries of GPCR binding domains may be translated to generate protein libraries. In some instances, libraries of GPCR binding domains are translated to generate peptide libraries, immunoglobulin libraries, derivatives thereof, or combinations thereof. In some instances, libraries of GPCR binding domains are translated to generate protein libraries that are further modified to generate peptidomimetic libraries. In some instances, libraries of GPCR binding domains are translated to generate protein libraries that are used to generate small molecules.

Methods described herein provide for synthesis of libraries of GPCR binding domains comprising nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the libraries of GPCR binding domains comprise varied nucleic acids collectively encoding variations at multiple positions. In some instances, the variant library comprises sequences encoding for variation of at least a single codon in a GPCR binding domain. In some instances, the variant library comprises sequences encoding for variation of multiple codons in a GPCR binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of libraries comprising nucleic acids encoding for the GPCR binding domains, wherein the libraries comprise sequences encoding for variation of length of the GPCR binding domains. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Following identification of GPCR binding domains, the GPCR binding domains may be placed in scaffolds as described herein. In some instances, the scaffolds are immunoglobulins. In some instances, the GPCR binding domains are placed in the CDR-H3 region. GPCR binding domains that may be placed in scaffolds can also be referred to as a motif. Scaffolds comprising GPCR binding domains may be designed based on binding, specificity, stability, expression, folding, or downstream activity. In some instances, the scaffolds comprising GPCR binding domains enable contact with the GPCRs. In some instances, the scaffolds comprising GPCR binding domains enables high affinity binding with the GPCRs. Exemplary amino acid sequences of GPCR binding domains are described in Table 2.

TABLE 2

GPCR amino acid sequences

| SEQ ID NO | GPCR | Amino Acid Sequence |
|---|---|---|
| 1 | CXCR4 | MEGISIYTSDNYTEEMGSGDYDSMKEPCFREENANFNKIFLPTIYSIIFL TGIVGNGLVILVMGYQKKLRSMTDKYRLHLSVADLLFVITLPFWAVD AVANWYFGNFLCKAVHVIYTVNLYSSVLILAFISLDRYLAIVHATNSQ RPRKLLAEKVVYVGVWIPALLLTIPDFIFANVSEADDRYICDRFYPND LWVVVFQFQHIMVGLILPGIVILSCYCIIISKLSHSKGHQKRKALKTTVI LILAFFACWLPYYIGISIDSFILLEIIKQGCEFENTVHKWISITEALAFFH CCLNPILYAFLGAKFKTSAQHALTSVSRGSSLKILSKGKRGGHSSVSTE SESSSFHSS |
| 2 | CCR4 | MNPTDIADTTLDESIYSNYYLYESIPKPCTKEGIKAFGELFLPPLYSLVF VFGLLGNSVVVLVLFKYKRLRSMTDVYLLNLAISDLLFVFSLPFWGY YAADQWVFGLGLCKMISWMYLVGFYSGIFFVMLMSIDRYLAIVHAV FSLRARTLTYGVITSLATWSVAVFASLPGFLFSTCYTERNHTYCKTKY SLNSTTWKVLSSLEINILGLVIPLGIMLFCYSMIIRTLQHCKNEKKNKA VKMIFAVVVLFLGFWTPYNIVLFLETLVELEVLQDCTFERYLDYAIQA TETLAFVHCCLNPIIYFFLGEKFRKYILQLFKTCRGLFVLCQYCGLLQI YSADTPSSSYTQSTMDHDLHDAL |
| 3 | GCGR | MPPCQPQRPLLLLLLLLACQPQVPSAQVMDFLFEKWKLYGDQCHHN LSLLPPPTELVCNRTFDKYSCWPDTPANTTANISCPWYLPWHHKVQH RFVFKRCGPDGQWVRGPRGQPWRDASQCQMDGEEIEVQKEVAKMY SSFQVMYTVGYSLSLGALLLALAILGGLSKLHCTRNAIHANLFASFVL KASSVLVIDGLLRTRYSQKIGDDLSVSTWLSDGAVAGCRVAAVFMQ YGIVANYCWLLVEGLYLHNLLGLATLPERSFFSLYLGIGWGAPMLFV VPWAVVKCLFENVQCWTSNDNMGFWWILRFPVFLAILINFFIFVRIVQ LLVAKLRARQMHHTDYKFRLAKSTLTLIPLLGVHEVVFAFVTDEHAQ GTLRSAKLFFDLFLSSFQGLLVAVLYCFLNKEVQSELRRRWHRWRLG KVLWEERNTSNHRASSSPGHGPPSKELQFGRGGGSQDSSAETPLAGG LPRLAESPF |
| 4 | mGluR5 | MVLLLILSVLLLKEDVRGSAQSSERRVVAHMPGDIIIGALFSVHHQPT VDKVHERKCGAVREQYGIQRVEAMLHTLERINSDPTLLPNITLGCEIR DSCWHSAVALEQSIEFIRDSLISSEEEEGLVRCVDGSSSSFRSKKPIVGV IGPGSSSVAIQVQNLLQLFNIPQIAYSATSMDLSDKTLFKYPMRVVPSD AQQARAMVDIVKRYNWTYVSAVHTEGNYGESGMEAFKDMSAKEGI CIAHSYKIYSNAGEQSPDKLLKKLTSHLPKARVVACFCEGMTVRGLL MAMRRLGLAGEFLLLGSDGWADRYDVTDGYQREAVGGITIKLQSPD VKWFDDYYLKLRPETNHRNPWFQEFWQHRFQCRLEGFPQENSKYNK TCNSSLTLKTHHVQDSKMGFVINAIYSMAYGLHNMQMSLCPGYAGL CDAMKPIDGRKLLESLMKTNFTGVSGDTILFDENGDSPGRYEIMNFKE MGKDYFDYINVGSWDNGELKMDDDEVWSKKSNIIRSVCSEPCEKGQI KVIRKGEVSCCWTCTPCKENEYVFDEYTCKACQLGSWPTDDLTGCD LIPVQYLRWGDPEPIAAVVFACLGLLATLFVTVVFIIYRDTPVVKSSSR ELCYIILAGICLGYLCTFCLIAKPKQIYCYLQRIGIGLSPAMSYSALVTK TNRIARILAGSKKKICTKKPRFMSACAQLVIAFILICIQLGIIVALFIMEP PDIMHDYPSIREVYLICNTTNLGVVTPLGYNGLLILSCTFYAFKTRNVP ANFNEAKYIAFTMYTTCIIWLAFVPIYFGSNYKIITMCFSVSLSATVAL GCMFVPKVYIILAKPERNVRSAFTTSTVVRMHVGDGKSSSAASRSSSL VNLWKRRGSSGETLRYKDRRLAQHKSEIECFTPKGSMGNGGRATMS SSNGKSVTWAQNEKSSRGQHLWQRLSIHINKKENPNQTAVIKPFPKST ESRGLGAGAGAGGSAGGVGATGGVEGAGAGPGGPESPDAGPKALY DVAEAEEHFPAPARPRSPSPISTLSHRAGSASRTDDDVPSLHSEPVARS SSSQGSLMEQISSVVTRFTANISELNSMMLSTAAPSPGVGAPLCSSYLI PKEIQLPTTMTTFAEIQPLPAIEVTGGAQPAAGAQAAGDAARESPAAG PEAAAAKPDLEELVALTPPSPFRDSVDSGSTTPNSPVSESALCIPSSPKY DTLIIRDYTQSSSSL |
| 5 | GLP-1R | RPQGATVSLWETVQKWREYRRQCQRSLTEDPPPATDLFCNRTFDEYA CWPDGEPGSFVNVSCPWYLPWASSVPQGHVYRFCTAEGLWLQKDNS SLPWRDLSECEESKRGERSSPEEQLLFLYIIYTVGYALSFSALVIASAIL LGFRHLHCTRNYIHLNLFASFILRALSVFIKDAALKWMYSTAAQQHQ WDGLLSYQDSLSCRLVFLLMQYCVAANYYWLLVEGVYLYTLLAFSV LSEQWIFRLYVSIGWGVPLLFVVPWGIVKYLYEDEGCWTRNSNMNY WLIIRLPILFAIGVNFLIFVRVICIVVSKLKANLMCKTDIKCRLAKSTLT |

TABLE 2-continued

GPCR amino acid sequences

| SEQ ID NO | GPCR | Amino Acid Sequence |
|---|---|---|
| | | LIPLLGTHEVIFAFVMDEHARGTLRFIKLFTELSFTSFQGLMVAILYCF VNNEVQLEFRKSWERWRLEHLHIQRDSSMKPLKCPTSSLSSGATAGS SMYTATCQASCS |
| 6 | GABAB | MLLLLLLAPLFLRPPGAGGAQTPNATSEGCQIIHPPWEGGIRYRGLTR DQVKAINFLPVDYEIEYVCRGEREVVGPKVRKCLANGSWTDMDTPS RCVRICSKSYLTLENGKVFLTGGDLPALDGARVDFRCDPDFHLVGSS RSICSQGQWSTPKPHCQVNRTPHSERRAVYIGALFPMSGGWPGGQAC QPAVEMALEDVNSRRDILPDYELKLIHHDSKCDPGQATKYLELLYN DPIKIILMPGCSSVSTLVAEAARMWNLIVLSYGSSSPALSNRQRFPTFF RTHPSATLHNPTRVKLFEKWGWKKIATIQQTTEVFTSTLDDLEERVKE AGIEITFRQSFFSDPAVPVKNLKRQDARIIVGLFYETEARKVFCEVYKE RLFGKKYVWFLIGWYADNWFKIYDPSINCTVDEMTEAVEGHITTEIV MLNPANTRSISNMTSQEFVEKLTKRLKRHPEETGGFQEAPLAYDAIW ALALALNKTSGGGGRSGVRLEDFNYNNQTITDQIYRAMNSSSFEGVS GHVVFDASGSRMAWTLIEQLQGGSYKKIGYYDSTKDDLSWSKTDKW IGGSPPADQTLVIKTFRFLSQKLFISVSVLSSLGIVLAVVCLSFNIYNSH VRYIQNSQPNLNNLTAVGCSLALAAVFPLGLDGYHIGRNQFPFVCQA RLWLLGFSLGYGSMFTKIWWVHTVPTKKEEKKEWRKTLEPWKL YATVGLLVGMDVLTLAIWQIVDPLHRTIETFAKEEPKEDIDVSILPQLE HCSSRKMNTWLGIFYGYKGLLLLLGIFLAYETKSVSTEKINDHRAVG MAIYNVAVLCLITAPVTMILSSQQDAAFAFASLAIVFSSYITLVVLFVP KMRRLITRGEWQSEAQDTMKTGSSTNNNEEEKSRLLEKENRELEKIIA EKEERVSELRHQLQSRQQLRSRRHPPTPPEPSGGLPRGPPEPPDRLSCD GSRVHLLYK |
| 7 | OPRM1 | MDSSAAPTNASNCTDALAYSSCSPAPSPGSWVNLSHLDGNLSDPCGP NRTDLGGRDSLCPPTGSPSMITAITIMALYSIVCVVGLFGNFLVMYVIV RYTKMKTATNIYIFNLALADALATSTLPFQSVNYLMGTWPFGTILCKI VISIDYYNMFTSIFTLCTMSVDRYIAVCHPVKALDFRTPRNAKIINVCN WILSSAIGLPVMFMATTKYRQGSIDCTLTFSHPTWYWENLLKICVFIF AFIMPVLIITVCYGLMILRLKSVRMLSGSKEKDRNLRRITRMVLVVVA VFIVCWTPIHIYVIIKALVTIPETTFQTVSWHFCIALGYTNSCLNPVLYA FLDENFKRCFREFCIPTSSNIEQQNSTRIRQNTRDHPSTANTVDRTNHQ LENLEAETAPLP |
| 8 | OPRK1 | MDSPIQIFRGEPGPTCAPSACLPPNSSAWFPGWAEPDSNGSAGSEDAQ LEPAHISPAIPVIITAVYSVVFVVGLVGNSLVMFVIIRYTKMKTATNIYI FNLALADALVTTTMPFQSTVYLMNSWPFGDVLCKIVISIDYYNMFTSI FTLTMMSVDRYIAVCHPVKALDFRTPLKAKIINICIWLLSSSVGISAIVL GGTKVREDVDVIECSLQFPDDDYSWWDLFMKICVFIFAFVIPVLIIIVC YTLMILRLKSVRLLSGSREKDRNLRRITRLVLVVVAVFVVCWTPIHIFI LVEALGSTSHSTAALSSYYFCIALGYTNSSLNPILYAFLDENFKRCFRD FCFPLKMRMERQSTSRVRNTVQDPAYLRDIDGMNKPV |
| 9 | C5aR | MDSFNYTTPDYGHYDDKDTLDLNTPVDKTSNTLRVPDILALVIFAVV FLVGVLGNALVVWVTAFEAKRTINAIWFLNLAVADFLSCLALPILFTS IVQHHHWPFGGAACSILPSLILLNMYASILLLATISADRFLLVFKPIWC QNFRGAGLAWIACAVAWGLALLLTIPSFLYRVVREEYFPPKVLCGVD YSHDKRRERAVAIVRLVLGFLWPLLTLTICYTFILLRTWSRRATRSTK TLKVVVAVVASFFIFWLPYQVTGIMMSFLEPSSPTFLLLKKLDSLCVSF AYINCCINPIIYVVAGQGFQGRLRKSLPSLLRNVLTEESVVRESKSFTR STVDTMAQKTQAV |
| 10 | CGRP | ELEESPEDSIQLGVTRNKIMTAQYECYQKIMQDPIQQAEGVYCNRTW DGWLCWNDVAAGTESMQLCPDYFQDFDPSEKVTKICDQDGNWFRH PASNRTWTNYTQCNVNTHEKVKTALNLFYLTIIGHGLSIASLLISLGIF FYFKSLSCQRITLHKNLFFSFVCNSVVTIIHLTAVANNQALVATNPVSC KVSQFIHLYLMGCNYFWMLCEGIYLHTLIVVAVFAEKQHLMWYYFL GWGFPLIPACIHAIARSLYYNDNCWISSDTHLLYIIHGPICAALLVNLFF LLNIVRVLITKLKVTHQAESNLYMKAVRATLILVPLLGIEFVLIPWRPE GKIAEEVYDYIMHILMHFQGLLVSTIFCFFNGEVQAILRRNWNQYKIQ FGNSFSNSEALRSASYTVSTISDGPGYSHDCPSEHLNGKSIHDIENVLL KPENLYN |
| 11 | M1 muscarinic | MNTSAPPAVSPNITVLAPGKGPWQVAFIGITTGLLSLATVTGNLLVLIS FKVNTELKTVNNYFLLSLACADLIIGTFSMNLYTTYLLMGHWALGTL ACDLWLALDYVASNASVMNLLLISFDRYFSVTRPLSYRAKRTPRRAA LMIGLAWLVSFVLWAPAILFWQYLVGERTVLAGQCYIQFLSQPIITFG TAMAAFYLPVTVMCTLYWRIYRETENRARELAALQGSETPGKGGGS SSSSERSQPGAEGSPETPPGRCCRCCRAPRLLQAYSWKEEEEEDEGSM ESLTSSEGEEPGSEVVIKMPMVDPEAQAPTKQPPRSSPNTVKRPTKKG |

TABLE 2-continued

GPCR amino acid sequences

| SEQ ID NO | GPCR | Amino Acid Sequence |
|---|---|---|
| | | RDRAGKGQKPRGKEQLAKRKTFSLVKEKKAARTLSAILLAFILTWTP YNIMVLVSTFCKDCVPETLWELGYWLCYVNSTINPMCYALCNKAFR DTFRLLLLCRWDKRRWRKIPKRPGSVHRTPSRQC |
| 12 | M4 muscarinic | MANFTPVNGSSGNQSVRLVTSSSHNRYETVEMVFIATVTGSLSLVTV VGNILVMLSIKVNRQLQTVNNYFLFSLACADLIIGAFSMNLYTVYIIKG YWPLGAVVCDLWLALDYVVSNASVMNLLIISFDRYFCVTKPLTYPAR RTTKMAGLMIAAAWVLSFVLWAPAILFWQFVVGKRTVPDNQCFIQF LSNPAVTFGTAIAAFYLPVVIMTVLYIHISLASRSRVHKHRPEGPKEKK AKTLAFLKSPLMKQSVKKPPPGEAAREELRNGKLEEAPPPALPPPPRP VADKDTSNESSSGSATQNTKERPATELSTTEATTPAMPAPPLQPRALN PASRWSKIQIVTKQTGNECVTAIEIVPATPAGMRPAANVARKFASIAR NQVRKKRQMAARERKVTRTIFAILLAFILTWTPYNVMVLVNTFCQSC IPDTVWSIGYWLCYVNSTINPACYALCNATFKKTFRHLLLCQYRNIGT AR |
| 13 | CCR2 | MLSTSRSRFIRNTNESGEEVTTFFDYDYGAPCHKFDVKQIGAQLLPPL YSLVFIFGFVGNMLVVLILINCKKLKCLTDIYLLNLAISDLLFLITLPLW AHSAANEWVFGNAMCKLFTGLYHIGYFGGIFFIILLTIDRYLAIVHAVF ALKARTVTFGVVTSVITWLVAVFASVPGIIFTKCQKEDSVYVCGPYFP RGWNNPHTIMRNILGLVLPLLIMVICYSGILKTLLRCRNEKKRHRAVR VIFTIMIVYFLFWTPYNIVILLNTFQEFFGLSNCESTSQLDQATQVETL GMTHCCINPIIYAFVGEKFRSLFHIALGCRIAPLQKPVCGGPGVRPGKN VKVTTQGLLDGRGKGKSIGRAPEASLQDKEGA |
| 14 | CCR9 | MTPTDFTSPIPNMADDYGSESTSSMEDYVNFNFTDFYCEKNNVRQFA SHFLPPLYWLVFIVGALGNSLVILVYWYCTRVKTMTDMFLLNLAIAD LLFLVTLPFWAIAAADQWKFQTFMCKVVNSMYKMNFYSCVLLIMCI SVDRYIAIAQAMRAHTWREKRLLYSKMVCFTIWVLAAALCIPEILYS QIKEESGIAICTMVYPSDESTKLKSAVLTLKVILGFFLPFVVMACCYTII IHTLIQAKKSSKHKALKVTITVLTVFVLSQFPYNCILLVQTIDAYAMFI SNCAVSTNIDICFQVTQTIAFFHSCLNPVLYVFVGERFRRDLVKTLKNL GCISQAQWVSFTRREGSLKLSSMLLETTSGALSL |
| 15 | GPR174 | MPANYTCTRPDGDNTDFRYFIYAVTYTVILVPGLIGNILALWVFYGY MKETKRAVIFMINLAIADLLQVLSLPRIFYYLNHDWPFGPGLCMFCF YLKYVNMYASIYFLVCISVRRFWFLMYPFRFHDCKQKYDLYISIAGW LIICLACVLFPLLRTSDDTSGNRTKCFVDLPTRNVNLAQSVVMMTIGE LIGFVTPLLIVLYCTWKTVLSLQDKYPMAQDLGEKQKALKMILTCAG VFLICFAPYHFSFPLDFLVKSNEIKSCLARRVILIFHSVALCLASLNSCL DPVIYYFSTNEFRRRLSRQDLHDSIQLHAKSFVSNHTASTMTPELC |
| 16 | MASP-2 | TPLGPKWPEPVFGRLASPGFPGEYANDQERRWTLTAPPGYRLRLYFT HFDLELSHLCEYDFVKLSSGAKVLATLCGQESTDTERAPGKDTFYSL GSSLDITFRSDYSNEKPFTGFEAFYAAEDIDECQVAPGEAPTCDHHCH NHLGGFYCSCRAGYVLHRNKRTCSALCSGQVFTQRSGELSSPEYPRP YPKLSSCTYSISLEEGFSVILDFVESFDVETHPETLCPYDFLKIQTDREE HGPFCGKTLPHRIETKSNTVTITFVTDESGDHTGWKIHYTSTAQPCPYP MAPPNGHVSPVQAKYILKDSFSIFCETGYELLQGHLPLKSFTAVCQKD GSWDRPMPACSIVDCGPPDDLPSGRVEYITGPGVTTYKAVIQYSCEET FYTMKVNDGKYVCEADGFWTSSKGEKSLPVCEPVCGLSARTTGGRI YGGQKAKPGDFPWQVLILGGTTAAGALLYDNWVLTAAHAVYEQKH DASALDIRMGTLKRLSPHYTQAWSEAVFIHEGYTHDAGFDNDIALIKL NNKVVINSNITPICLPRKEAESFMRTDDIGTASGWGLTQRGFLARNLM YVDIPIVDHQKCTAAYEKPPYPRGSVTANMLCAGLESGGKDSCRGDS GGALVFLDSETERWFVGGIVSWGSMNCGEAGQYGVYTKVINYIPWIE NIISDF |
| 17 | CCR5 | MDYQVSSPIYDINYYTSEPCQKINVKQIAARLLPPLYSLVFIFGFVGNM LVILILINCKRLKSMTDIYLLNLAISDLFFLLTVPFWAHYAAAQWDFG NTMCQLLTGLYFIGFFSGIFFIILLTIDRYLAVVHAVFALKARTVTFGV VTSVITWVVAVFASLPGIIFTRSQKEGLHYTCSSHFPYSQYQFWKNFQ TLKIVILGLVLPLLVMVICYSGILKTLLRCRNEKKRHRAVRLIFTIMIVY FLFWAPYNIVLLLNTFQEFFGLNNCSSSNRLDQAMQVTETLGMTHCCI NPIIYAFVGEKFRNYLLVFFQKHIAKRFCKCCSIFQQEAPERASSVYTR STGEQEISVGL |
| 18 | FSHR | CHHRICHCSNRVFLCQESKVTEIPSDLPRNAIELRFVLTKLRVIQKGAF SGFGDLEKIEISQNDVLEVIEADVFSNLPKLHEIRIEKANNLLYINPEAF QNLPNLQYLLISNTGIKHLPDVHKIHSLQKVLLDIQDNINIHTIERNSFV GLSFESVILWLNKNGIQEIHNCAFNGTQLDELNLSDNNNLEELPNDVF HGASGPVILDISRTRIHSLPSYGLENLKKLRARSTYNLKKLPTLEKLVA LMEASLTYPSHCCAFANWRRQISELHPICNKSILRQEVDYMTQARGQ RSSLAEDNESSYSRGFDMTYTEFDYDLCNEVVDVTCSPKPDAFNPCE |

TABLE 2-continued

GPCR amino acid sequences

| SEQ ID NO | GPCR | Amino Acid Sequence |
|---|---|---|
| | | DIMGYNILRVLIWFISILAITGNIIVLVILTTSQYKLTVPRFLMCNLAFA DLCIGIYLLLIASVDIHTKSQYHNYAIDWQTGAGCDAAGFFTVFASEL SVYTLTAITLERWHTITHAMQLDCKVQLRHAASVMVMGWIFAFAAA LFPIFGISSYMKVSICLPMDIDSPLSQLYVMSLLVLNVLAFVVICGCYIH IYLTVRNPNIVSSSSDTRIAKRMAMLIFTDFLCMAPISFFAISASLKVPLI TVSKAKILLVLFHPINSCANPFLYAIFTKNFRRDFFILLSKCGCYEMQA QIYRTETSSTVHNTHPRNGHCSSAPRVTNGSTYILVPLSHLAQN |
| 19 | mGluR2 PAM | EGPAKKVLTLEGDLVLGGLFPVHQKGGPAEDCGPVNEHRGIQRLEA MLFALDRINRDPHLLPGVRLGAHILDSCSKDTHALEQALDFVRASLSR GADGSRHICPDGSYATHGDAPTAITGVIGGSYSDVSIQVANLLRLFQIP QISYASTSAKLSDKSRYDYFARTVPPDFFQAKAMAEILRFFNWTYVST VASEGDYGETGIEAFELEARARNICVATSEKVGRAMSRAAFEGVVRA LLQKPSARVAVLFTRSEDARELLAASQRLNASFTWVASDGWGALES VVAGSEGAAEGAITIELASYPISDFASYFQSLDPWNNSRNPWFREFWE QRFRCSFRQRDCAAHSLRAVPFEQESKIMFVVNAVYAMAHALHNMH RALCPNTTRLCDAMRPVNGRRLYKDFVLNVKFDAPFRPADTHNEVR FDRFGDGIGRYNIFTYLRAGSGRYRYQKVGYWAEGLTLDTSLIPWAS PSAGPLPASRCSEPCLQNEVKSVQPGEVCCWLCIPCQPYEYRLDEFTC ADCGLGYWPNASLTGCFELPQEYIRWGDAWAVGPVTIACLGALATL FVLGVFVRHNATPVVKASGRELCYILLGGVFLCYCMTFIFIAKPSTAV CTLRRLGLGTAFSVCYSALLTKTNRIARIFGGAREGAQRPRFISPASQV AICLALISGQLLIVVAWLVVEAPGTGKETAPERREVVTLRCNHRDAS MLGSLAYNVLLIALCTLYAPKTRKCPENFNEAKFIGFTMYTTCIIWLA FLPIFYVTSSDYRVQTTTMCVSVSLSGSVVLGCLFAPKLHIILFQPQKN VVSHRAPTSRFGSAAARASSSLGQGSGSQFVPTVCNGREVVDSTTSSL |
| 20 | mGluR3 | LGDHNFLRREIKIEGDLVLGGLFPINEKGTGTEECGRINEDRGIQRLEA MLFAIDEINKDDYLLPGVKLGVHILDTCSRDTYALEQSLEFVRASLTK VDEAEYMCPDGSYAIQENIPLLIAGVIGGSYSSVSIQVANLLRLFQIPQI SYASTSAKLSDKSRYDYFARTVPPDFYQAKAMAEILRFFNWTYVSTV ASEGDYGETGIEAFEQEARLRNICIATAEKVGRSNIRKSYDSVIRELLQ KPNARVVVLFMRSDDSRELIAAASRANASFTWVASDGWGAQESIIKG SEHVAYGAITLELASQPVRQFDRYFQSLNPYNNHRNPWFRDFWEQKF QCSLQNKRNHRRVCDKHLAIDSSNYEQESKIMFVVNAVYAMAHALH KMQRTLCPNTTKLCDAMKILDGKKLYKDYLLKINFTAPFNPNKDADS IVKFDTFGDGMGRYNVFNFQNVGGKYSYLKVGHWAETLSLDVNSIH WSRNSVPTSQCSDPCAPNEMKNMQPGDVCCWICIPCEPYEYLADEFT CMDCGSGQWPTADLTGCYDLPEDYIRWEDAWAIGPVTIACLGFMCT CMVVTVFIKHNNTPLVKASGRELCYILLFGVGLSYCMTFFFIAKPSPVI CALRRLGLGSSFAICYSALLTKTNCIARIFDGVKNGAQRPKFISPSSQV FICLGLILVQIMVSVWLILEAPGTRRYTLAEKRETVILKCNVKDSSM LISLTYDVILVILCTVYAFKTRKCPENFNEAKFIGFTMYTTCIIWLAFLP IFYVTSSDYRVQTTTMCISVSLSGFVVLGCLFAPKVHIILFQPQKNVVT HRLHLNRFSVSGTGTTYSQSSASTYVPTVCNGREVLDSTTSSL |
| 21 | mGluR4 | KPKGHPHMNSIRIDGDITLGGLFPVHGRGSEGKPCGELKKEKGIHRLE AMLFALDRINNDPDLLPNITLGARILDTCSRDTHALEQSLTFVQALIEK DGTEVRCGSGGPPIITKPERVVGIGASGSSVSIMVANILRLFKIPQISY ASTAPDLSDNSRYDFFSRVVPSDTYQAQAMVDIVRALKWNYVSTVA SEGSYGESGVEAFIQKSREDGGVCIAQSVKIPREPKAGEFDKIIRRLLET SNARAVIIFANEDDIRRVLEAARRANQTGHFFWMGSDSWGSKIAPVL HLEEVAEGAVTILPKRMSVRGFDRYFSSRTLDNNRRNIWFAEFWEDN FHCKLSRHALKKGSHVKKCTNRERIGQDSAYEQEGKVQFVIDAVYA MGHALHAMHRDLCPGRVGLCPRMDPVDGTQLLKYIRNVNFSGIAGN PVTFNENGDAPGRYDIYQYLRNDSAEYKVIGSWTDHLHLRIERMH WPGSGQQLPRSICSLPCQPGERKKTVKGMPCCWHCEPCTGYQYQVD RYTCKTCPYDMRPTENRTGCRPIPIIKLEWGSPWAVLPLFLAVVGIAA TLFVVITFVRYNDTPIVKASGRELSYVLLAGIFLCYATTFLMIAEPDLG TCSLRRIFLGLGMSISYAALLTKTNRIYRIFEQGKRSVSAPRFISPASQL AITFSLISLQLLGICVWFVVDPSHSVVDFQDQRTLDPRFARGVLKCDIS DLSLICLLGYSMLLMVTCTVYAIKTRGVPETFNEAKPIGFTMYTTCIV WLAFIPIFFGTSQSADKLYIQTTTLTVSVSLSASVSLGMLYMPKVYIILF HPEQNVPKRKRSLKAVVTAATMSNKFTQKGNFRPNGEAKSELCENL EAPALATKQTYVTYTNHAI |
| 22 | mGluR7 | QEMYAPHSIRIEGDVTLGGLFPVHAKGPSGVPCGDIKRENGIHRLEAM LYALDQINSDPNLLPNVTLGARILDTCSRDTYALEQSLTFVQALIQKD TSDVRCTNGEPPVFVKPEKVVGVIGASGSSVSIMVANILRLFQIPQISY ASTAPELSDDRRYDFFSRVVPPDSFQAQAMVDIVKALGWNYVSTLAS EGSYGEKGVESFTQISKEAGGLCIAQSVRIPQERKDRTIDFDRIIKQLLD TPNSRAVVIFANDEDIKQILAAAKRADQVGHFLWVGSDSWGSKINPL HQHEDIAEGAITIQPKRATVEGFDAYFTSRTLENNRRNVWFAEYWEE NFNCKLTISGSKKEDTDRKCTGQERIGKDSNYEQEGKVQFVIDAVYA |

TABLE 2-continued

GPCR amino acid sequences

| SEQ ID NO | GPCR | Amino Acid Sequence |
|---|---|---|
| | | MAHALHHMNKDLCADYRGVCPEMEQAGGKKLLKYIRNVNFNGSAG<br>TPVMFNKNGDAPGRYDIFQYQTTNTSNPGYRLIGQWTDELQLNIEDM<br>QWGKGVREIPASVCTLPCKPGQRKTQKGTPCCWTCEPCDGYQYQF<br>DEMTCQHCPYDQRPNENRTGCQDIPIIKLEWHSPWAVIPVFLAMLGII<br>ATIFVMATFIRYNDTPIVRASGRELSYVLLTGIFLCYIITFLMIAKPDVA<br>VCSFRRVFLGLGMCISYAALLTKTNRIYRIFEQGKKSVTAPRLISPTSQ<br>LAITSSLISVQLLGVFIWFGVDPPNIIIDYDEHKTMNPEQARGVLKCDIT<br>DLQIICSLGYSILLMVTCTVYAIKTRGVPENFNEAKPIGFTMYTTCIVW<br>LAFIPIFFGTAQSAEKLYIQTTTLTISMNLSASVALGMLYMPKVYIIIFH<br>PELNVQKRKRSFKAVVTAATMSSRLSHKPSDRPNGEAKTELCENVDP<br>NSPAAKKKYVSYNNLVI |
| 23 | CXCR3 | MVLEVSDHQVLNDAEVAALLENFSSSYDYGENESDSCCTSPPCPQDF<br>SLNFDRAFLPALYSLLFLLGLLGNGAVAAVLLSRRTALSSTDTFLLHL<br>AVADTLLVLTLPLWAVDAAVQWVFGSGLCKVAGALFNINFYAGALL<br>LACISFDRYLNIVHATQLYRRGPPARVTLTCLAVWGLCLLFALPDFIFL<br>SAHHDERLNATHCQYNFPQVGRTALRVLQLVAGFLLPLLVMAYCYA<br>HILAVLLVSRGQRRLRAMRLVVVVVVAFALCWTPYHLVVLVDILMD<br>LGALARNCGRESRVDVAKSVTSGLGYMHCCLNPLLYAFVGVKFRER<br>MWMLLLRLGCPNQRGLQRQPSSSRRDSSWSETSEASYSGL |
| 24 | CCR8 | MDYTLDLSVTTVTDYYYPDIFSSPCDAELIQTNGKLLLAVFYCLLFVF<br>SLLGNSLVILVLVVCKKLRSITDVYLLNLALSDLLFVFSFPPQTYYLLD<br>QWVFGTVMCKVVSGFYYIGFYSSMFFITLMSVDRYLAVVHAVYALK<br>VRTIRMGTTLCLAVWLTAIMATIPLLVFYQVASEDGVLQCYSFYNQQ<br>TLKWKIFTNFKMNILGLLIPFTIFMFCYIKILHQLKRCQNHNKTKAIRL<br>VLIVVIASLLFWVPFNVVLFLTSLHSMHILDGCSISQQLTYATHVTEIIS<br>FTHCCVNPVIYAFVGEKFKKHLSEIFQKSCSQIFNYLGRQMPRESCEKS<br>SSCQQHSSRSSSVDYIL |
| 25 | Adenosine A2a | MPIMGSSVYITVELAIAVLAILGNVLVCWAVWLNSNLQNVTNYFVVS<br>LAAADIAVGVLAIPFAITISTGFCAACHGCLFIACFVLVLTQSSIFSLLAI<br>AIDRYIAIRIPLRYNGLVTGTRAKGIIAICWVLSFAIGLTPMLGWNNCG<br>QPKEGKNHSQGCGEGQVACLFEDVVPMNYMVYFNFFACVLVPLLL<br>MLGVYLRIFLAARRQLKQMESQPLPGERARSTLQKEVHAAKSLAIIV<br>GLFALCWLPLHIINCFTFFCPDCSHAPLWLMYLAIVLSHTNSVVNPFIY<br>AYRIREFRQTFRKIIRSHVLRQQEPFKAAGTSARVLAAHGSDGEQVSL<br>RLNGHPPGVWANGSAPHPERRPNGYALGLVSGGSAQESQGNTGLPD<br>VELLSHELKGVCPEPPGLDDPLAQDGAGVS |
| 26 | Orexin OX1 | MEPSATPGAQMGVPPGSREPSPVPPDYEDEEFLRYLWRDYLYPKQYE<br>WVLIAAYVAVFVVALVGNTLVCLAVWRNHHMRTVTNYFIVNLSLA<br>DVLVTAICLPASLLVDITESWLFGHALCKVIPYLQAVSVSVAVLTLSFI<br>ALDRWYAICHPLLFKSTARRARGSILGIWAVSLAIMVPQAAVMECSS<br>VLPELANRTRLFSVCDERWADDLYPKIYHSCFFIVTYLAPLGLMAMA<br>YFQIFRKLWGRQIPGTTSALVRNWKRPSDQLGDLEQGLSGEPQPRAR<br>AFLAEVKQMRARRKTAKMLVVLLVFALCYLPISVLNVLKRVFGMF<br>RQASDREAVYACFTFSHWLVYANSAANPIIYNFLSGKFREQFKAAFSC<br>CLPGLGPCGSLKAPSPRSSASHKSLSLQSRCSISKISEHVVLTSVTTVLP |
| 27 | Orexin OX2 | MSGTKLEDSPPCRNWSSASELNETQEPPFLNPTDYDDEEFLRYLWREY<br>LHPKEYEWVLIAGYIIVFVVALIGNVLVCVAVWKNHHMRTVTNYFIV<br>NLSLADVLVTITCLPATLVVDITETWFFGQSLCKVIPYLQTVSVSVSVL<br>TLSCIALDRWYAICHPLMFKSTAKRARNSIVIIWIVSCIIMIPQAIVMEC<br>STVFPGLANKTTLFTVCDERWGGEIYPKMYHICFFLVTYMAPLCLMV<br>LAYLQIFRKLWCRQIPGTSSVVQRKWKPLQPVSQPRGPGQPTKSRMS<br>AVAAEIKQIRARRKTARMLMIVLLVFAICYLPISILNVLKRVFGMFAH<br>TEDRETVYAWFTFSHWLVYANSAANPIIYNFLSGKFREEFKAAFSCCC<br>LGVHHRQEDRLTRGRTSTESRKSLTTQISNFDNISKLSEQVVLTSISTLP<br>AANGAGPLQNW |
| 28 | PAR-2 | IQGTNRSSKGRSLIGKVDGTSHVTGKGVTVETVFSVDEFSASVLTGKL<br>TTVFLPIVYTIVFVVGLPSNGMALWVFLFRTKKKHPAVIYMANLALA<br>DLLSVIWFPLKIAYHIHGNNWIYGEALCNVLIGFFYGNMYCSILFMTC<br>LSVQRYWVIVNPMGHSRKKANIAIGISLAIWLLILLVTIPLYVVKQTIFI<br>PALNITTCHDVLPEQLLVGDMFNYFLSLAIGVFLFPAFLTASAYVLMI<br>RMLRSSAMDENSEKKRKRAIKLIVTVLAMYLICFTPSNLLLVVHYFLI<br>KSQGQSHVYALYIVALCLSTLNSCIDPFVYYFVSHDFRDHAKNALLC<br>RSVRTVKQMQVSLTSKKHSRKSSSYSSSSTTVKTSY |
| 29 | C3aR | MASFSAETNSTDLLSQPWNEPPVILSMVILSLTFLLGLPGNGLVLWVA<br>GLKMQRTVNTIWFLHLTLADLLCCLSLPFSLAHLALQGQWPYGRFLC<br>KLIPSIIVLNMFASVFLLTAISLDRCLVVFKPIWCQNHRNVGMACSICG<br>CIWVVAFVMCIPVFVYREIFTTDNHNRCGYKFGLSSSLDYPDFYGDPL |

TABLE 2-continued

GPCR amino acid sequences

| SEQ ID NO | GPCR | Amino Acid Sequence |
|---|---|---|
| | | ENRSLENIVQPPGEMNDRLDPSSFQTNDHPWTVPTVFQPQTFQRPSAD SLPRGSARLTSQNLYSNVFKPADVVSPKIPSGFPIEDHETSPLDNSDAF LSTHLKLFPSASSNSFYESELPQGFQDYYNLGQFTDDDQVPTPLVAITI TRLVVGFLLPSVIMIACYSFIVFRMQRGRFAKSQSKTFRVAVVVVAVF LVCWTPYHIFGVLSLLTDPETPLGKTLMSWDHVCIALASANSCFNPFL YALLGKDFRKKARQSIQGILEAAFSEELTRSTHCPSNNVISERNSTTV |
| 30 | LGR5 | GSSPRSGVLLRGCPTHCHCEPDGRMLLRVDCSDLGLSELPSNLSVFTS YLDLSMNNISQLLPNPLPSLRFLEELRLAGNALTYIPKGAFTGLYSLKV LMLQNNQLRHVPTEALQNLRSLQSLRLDANHISYVPPSCFSGLHSLRH LWLDDNALTEIPVQAFRSLSALQAMTLALNKIHHIPDYAFGNLSSLVV LHLHNNRIHSLGKKCFDGLHSLETLDLNYNNLDEFPTAIRTLSNLKEL GFHSNNIRSIPEKAFVGNPSLITIHFYDNPIQFVGRSAFQHLPELRTLTL NGASQITEFPDLTGTANLESLTLTGAQISSLPQTVCNQLPNLQVLDLSY NLLEDLPSFSVCQKLQKIDLRHNEIYEIKVDTFQQLLSLRSLNLAWNKI AIIHPNAFSTLPSLIKLDLSSNLLSSFPITGLHGLTHLKLTGNHALQSLIS SENFPELKVIEMPYAYQCCAFGVCENAYKISNQWNKGDNSSMDDLH KKDAGMFQAQDERDLEDFLLDFEEDLKALHSVQCSPSPGPFKPCEHL LDGWLIRIGVWTIAVLALTCNALVTSTVFRSPLYISPIKLLIGVIAAVN MLTGVSSAVLAGVDAFTFGSFARHGAWWENGVGCHVIGFLSIFASES SVFLLTLAALERGFSVKYSAKFETKAPFSSLKVIILLCALLALTMAAVP LLGGSKYGASPLCLPLPFGEPSTMGYMVALILLNSLCFLMMTIAYTKL YCNLDKGDLENIWDCSMVKHIALLLFTNCILNCPVAFLSFSSLINLTFI SPEVIKFILLVVVPLPACLNPLLYILFNPHFKEDLVSLRKQTYVWTRSK HPSLMSINSDDVEKQSCDSTQALVTFTSSSITYDLPPSSVPSPAYPVTES CHLSSVAFVPCL |
| 31 | GPR101 | MTSTCTNSTRESNSSHTCMPLSKMPISLAHGIIRSTVLVIFLAASFVGNI VLALVLQRKPQLLQVTNRFIFNLLVTDLLQISLVAPWVVATSVPLFWP LNSHFCTALVSLTHLFAFASVNTIVVVSVDRYLSIIHPLSYPSKMTQRR GYLLLYGTWIVAILQSTPPLYGWGQAAFDERNALCSMIWGASPSYTIL SVVSFIVIPLIVMIACYSVVFCAARRQHALLYNVKRHSLEVRVKDCVE NEDEEGAEKKEEFQDESEFRRQHEGEVKAKEGRMEAKDGSLKAKEG STGTSESSVEARGSEEVRESSTVASDGSMEGKEGSTKVEENSMKADK GRTEVNQCSIDLGEDDMEFGEDDINFSEDDVEAVNIPESLPPSRRNSNS NPPLPRCYQCKAAKVIFIIIFSYVLSLGPYCFLAVLAVWVDVETQVPQ WVITIIIWLFFLQCCIHPYVYGYMHKTIKKEIQDMLKKFFCKEKPPKED SHPDLPGTEGGTEGKIVPSYDSATFP |
| 32 | GPR151 | MLAAAFADSNSSSMNVSFAHLHFAGGYLPSDSQDWRTIIPALLVAVC LVGFVGNLCVIGILLHNAWKGKPSMIHSLILNLSLADLSLLLFSAPIRA TAYSKSVWDLGWFVCKSSDWFIHTCMAAKSLTIVVVAKVCFMYASD PAKQVSIHNYTIWSVLVAIWTVASLLPLPEWFFSTIRHHEGVEMCLVD VPAVAEEEFMSMFGKLYPLLAFGLPLFFASFYFWRAYDQCKKRGTKT QNLRNQIRSKQVTVMLLSIAIISALLWLPEWVAWLWVWHLKAAGPA PPQGFIALSQVLMFSISSANPLIFLVMSEEFREGLKGVWKWMITKKPPT VSESQETPAGNSEGLPDKVPSPESPASIPEKEKPSSPSSGKGKTEKAEIPI LPDVEQFWHERDTVPSVQDNDPIPWEHEDQETGEGVK |
| 33 | GPR161 | MSLNSSLSCRKELSNLTEEEGGEGGVIITQFIAIIVITIFVCLGNLVIVVT LYKKSYLLTLSNKFVFSLTLSNFLLSVLVLPFVVTSSIRREWIFGVVWC NFSALLYLLISSASMLTLGVIAIDRYYAVLYPMVYPMKITGNRAVMA LVYIWLHSLIGCLPPLFGWSSVEFDEFKWMCVAAWHREPGYTAFWQI WCALFPFLVMLVCYGFIFRVARVKARKVHCGTVVIVEEDAQRTGRK NSSTSTSSSGSRRNAFQGVVYSANQCKALITILVVLGAFMVTWGPYM VVIASEALWGKSSVSPSLETWATWLSFASAVCHPLIYGLWNKTVRKE LLGMCFGDRYYREPFVQRQRTSRLFSISNRITDLGLSPHLTALMAGGQ PLGHSSSTGDTGFSCSQDSGTDMMLLEDYTSDDNPPSHCTCPPKRRSS VTFEDEVEQIKEAAKNSILHVKAEVHKSLDSYAASLAKAIEAEAKINL FGEEEALPGVLVTARTVPGGGFGGRRGSRTLVSQRLQLQSIEEGDVLA AEQR |
| 34 | GPR17 | MSKRSWWAGSRKPPREMLKLSGSDSSQSMNGLEVAPPGLITNFSLAT AEQCGQETPLENMLFASFYLLDFILALVGNTLALWLFIRDHKSGTPAN VFLMHLAVADLSCVLVLPTRLVYHFSGNHWPFGEIACRLTGFLFYLN MYASIYFLTCISADRFLAIVHPVKSLKLRRPLYAHLACAFLWVVVAV AMAPLLVSPQTVQTNHTVVCLQLYREKASHHALVSLAVAFTPPFITT VTCYLLIIRSLRQGLRVEKRLKTKAVRMIAIVLAIFLVCFVPYHVNRSV YVLHYRSHGASCATQRILALANRITSCLTSLNGALDPIMYFFVAEKFR HALCNLLCGKRLKGPPPSFEGKTNESSLSAKSEL |
| 35 | GPR183 | MDIQMANNFTPPSATPQGNDCDLYAHHSTARIVMPLHYSLVFIIGLVG NLLALVVIVQNRKKINSTTLYSTNLVISDILFTTALPTRIAYYAMGFDW RIGDALCRITALVFYINTYAGVNFMTCLSIDRFIAVVHPLRYNKIKRIE |

TABLE 2-continued

GPCR amino acid sequences

| SEQ ID NO | GPCR | Amino Acid Sequence |
|---|---|---|
| | | HAKGVCIFVWILVFAQTLPLLINPMSKQEAERITCMEYPNFEETKSLP<br>WILLGACFIGYVLPLIIILICYSQICCKLFRTAKQNPLTEKSGVNKKALN<br>TIILIIVVFVLCFTPYHVAIIQHMIKKLRFSNFLECSQRHSFQISLHFTVC<br>LMNFNCCMDPFIYFFACKGYKRKVMRMLKRQVSVSISSAVKSAPEEN<br>SREMTETQMMIHSKSSNGK |
| 36 | CRTH2 | MSANATLKPLCPILEQMSRLQSHSNTSIRYIDHAAVLLHGLASLLGLV<br>ENGVILFVVGCRMRQTVVTTWVLHLALSDLLASASLPFFTYFLAVGH<br>SWELGTTFCKLHSSIFFLNMFASGFLLSAISLDRCLQVVRPVWAQNHR<br>TVAAAHKVCLVLWALAVLNTVPYFVFRDTISRLDGRIMCYYNVLLL<br>NPGPDRDATCNSRQVALAVSKFLLAFLVPLAIIASSHAAVSLRLQHRG<br>RRRPGRFVRLVAAVVAAFALCWGPYHVFSLLEARAHANPGLRPLVW<br>RGLPFVTSLAFFNSVANPVLYVLTCPDMLRKLRRSLRTVLESVLVDDS<br>ELGGAGSSRRRRTSSTARSASPLALCSRPEEPRGPARLLGWLLGSCAA<br>SPQTGPLNRALSSTSS |
| 37 | 5-HT4 | MDKLDANVSSEEGFGSVEKVVLLTFLSTVILMAILGNLLVMVAVCW<br>DRQLRKIKTNYFIVSLAFADLLVSVLVMPFGAIELVQDIWIYGEVFCL<br>VRTSLDVLLTTASIFHLCCISLDRYYAICCQPLVYRNKMTPLRIALMLG<br>GCWVIPTFISFLPIMQGWNNIGIIDLIEKRKFNQNSNSTYCVFMVNKPY<br>AITCSVVAFYIPFLLMVLAYYRIYVTAKEHAHQIQMLQRAGASSESRP<br>QSADQHSTHRMRTETKAAKTLCIIMGCFCLCWAPFFVTNIVDPFIDYT<br>VPGQVWTAFLWLGYINSGLNPFLYAFLNKSFRRAFLIILCCDDERYRR<br>PSILGQTVPCSTTTINGSTHVLRDAVECGGQWESQCHPPATSPLVAAQ<br>PSDT |
| 38 | 5-HT6 | MVPEPGPTANSTPAWGAGPPSAPGGSGWVAAALCVVIALTAAANSL<br>LIALICTQPALRNTSNFFLVSLFTSDLMVGLVVMPPAMLNALYGRWV<br>LARGLCLLWTAFDVMCCSASILNLCLISLDRYLLILSPLRYKLRMTPL<br>RALALVLGAWSLAALASFLPLLLGWHELGHARPPVPGQCRLLASLPF<br>VLVASGLTFFLPSGAICFTYCRILLAARKQAVQVASLTTGMASQASET<br>LQVPRTPRPGVESADSRRLATKHSRKALKASLTLGILLGMFFVTWLPF<br>FVANIVQAVCDCISPGLFDVLTWLGYCNSTMNPIIYPLFMRDFKRALG<br>RFLPCPRCPRERQASLASPSLRTSHSGPRPGLSLQQVLPLPLPPDSDSDS<br>DAGSGGSSGLRLTAQLLLPGEATQDPPLPTRAAAAVNFFNIDPAEPEL<br>RPHPLGIPTN |
| 39 | CB2 | MEECWVTEIANGSKDGLDSNPMKDYMILSGPQKTAVAVLCTLLGLL<br>SALENVAVLYLILSSHQLRRKPSYLFIGSLAGADFLASVVFACSFVNFH<br>VFHGVDSKAVFLLKIGSVTMTFTASVGSLLLTAIDRYLCLRYPPSYKA<br>LLTRGRALVTLGIMWVLSALVSYLPLMGWTCCPRPCSELFPLIPNDYL<br>LSWLLFIAFLFSGIIYTYGHVLWKAHQHVASLSGHQDRQVPGMARMR<br>LDVRLAKTLGLVLAVLLICWFPVLALMAHSLATTLSDQVKKAFAFCS<br>MLCLINSMVNPVIYALRSGEIRSSAHHCLAHWKKCVRGLGSEAKEEA<br>PRSSVTETEADGKITPWPDSRDLDLSDC |
| 40 | Histamine-3 | MERAPPDGPLNASGALAGEAAAAGGARGFSAAWTAVLAALMALLIV<br>ATVLGNALVMLAFVADSSLRTQNNFFLLNLAISDFLVGAFCIPLYVPY<br>VLTGRWTFGRGLCKLWLVVDYLLCTSSAFNIVLISYDRFLSVTRAVS<br>YRAQQGDTRRAVRKMLLVWVLAFLLYGPAILSWEYLSGGSSIPEGHC<br>YAEFFYNWYFLITASTLEFFTPFLSVTFFNLSIYLNIQRRTRLRLDGARE<br>AAGPEPPPEAQPSPPPPPGCWGCWQKGHGEAMPLHRYGVGEAAVGA<br>EAGEATLGGGGGGGSVASPTSSSGSSSRGTERPRSLKRGSKPSASSAS<br>LEKRMKMVSQSFTQRFRLSRDRKVAKSLAVIVSIFGLCWAPYTLLMII<br>RAACHGHCVPDYWYETSFWLLWANSAVNPVLYPLCHHSFRRAFTKL<br>LCPQKLKIQPHSSLEHCWK |
| 41 | VPAC-1 or VIPR1 | ARLQEECDYVQMIEVQHKQCLEEAQLENETIGCSKMWDNLTCWPAT<br>PRGQVVVLACPLIFKLFSSIQGRNVSRSCTDEGWTHLEPGPYPIACGLD<br>DKAASLDEQQTMFYGSVKTGYTIGYGLSLATLLVATAILSLFRKLHCT<br>RNYIHMHLFISFILRAAAVFIKDLALFDSGESDQCSEGSVGCKAAMVF<br>FQYCVMANFFWLLVEGLYLYTLLAVSFFSERKYFWGYILIGWGVPST<br>FTMVWTIARIHFEDYGCWDTINSSLWWIIKGPILTSILVNFILFICIIRILL<br>QKLRPPDIRKSDSSPYSRLARSTLLLIPLFGVHYIMFAFFPDNFKPEVK<br>MVFELVVGSFQGFVVAILYCFLNGEVQAELRRKWRRWHLQGVLGW<br>NPKYRHPSGGSNGATCSTQVSMLTRVSPGARRSSSFQAEVSLV |
| 42 | GIPR | RAETGSKGQTAGELYQRWERYRRECQETLAAAEPPSGLACNGSFDM<br>YVCWDYAAPNATARASCPWYLPWHHEIVAAGFVLRQCGSDGQWGL<br>WRDHTQCENPEKNEAFLDQRLILERLQVMYTVGYSLSLATLLLALLIL<br>SLFRRLHCTRNYIHINLFTSFMLRAAAILSRDRLLPRPGPYLGDQALAL<br>WNQALAACRTAQIVTQYCVGANYTWLLVEGVYLHSLLVLGGSEE<br>GHFRYYLLLGWGAPALFVIPWVIVRYLYENTQCWERNEVKAIWWIIR<br>TPILMTILINFLIFIRILGILLSKLRTRQMRCRDYRLRLARSTLTLVPLLG |

TABLE 2-continued

GPCR amino acid sequences

| SEQ ID NO | GPCR | Amino Acid Sequence |
|---|---|---|
| | | VHEVVFAPVTEEQARGALRFAKLGFEIFLSSFQGFLVSVLYCFINKEV QSEIRRGWHHCRLRRSLGEEQRQLPERAFRALPSGSGPGEVPTSRGLS SGTLPGPGNEASRELESYC |
| 43 | 5-HT1B GPCR | MEEPGAQCAPPPPAGSETWVPQANLSSAPSQNCSAKDYIYQDSISLPW KVLLVMLLALITLATTLSNAFVIATVYRTRKLHTPANYLIASLAVTDL LVSILVMPISTMYTVTGRWTLGQVVCDFWLSSDITCCTASILHLCVIA LDRYWAITDAVEYSAKRTPKRAAVMIALVWVFSISISLPPFFWRQAK AEEEVSECVVNTDHILYTVYSTVGAFYFPTLLLIALYGRIYVEARSRIL KQTPNRTGKRLTRAQLITDSPGSTSSVTSINSRVPDVPSESGSPVYVNQ VKVRVSDALLEKKKLMAARERKATKTLGIILGAFIVCWLPFFIISLVM PICKDACWFHLAIFDFFTWLGYLNSLINPHYTMSNEDFKQAFHKLIRF KCTS |
| 44 | CCR7 | QDEVTDDYIGDNTTVDYTLFESLCSKKDVRNFKAWFLPIMYSIICFVG LLGNGLVVLTYIYFKRLKTMTDTYLLNLAVADILFLLTLPFWAYSAA KSWVFGVHFCKLIFAIYKMSFFSGMLLLLCISIDRYVAIVQAVSAHRH RARVLLISKLSCVGIWILATVLSIPELLYSDLQRSSSEQAMRCSLITEHV EAFITIQVAQMVIGFLVPLLAMSFCYLVIIRTLLQARNFERNKAIKVIIA VVVVFIVFQLPYNGVVLAQTVANFNITSSTCELSKQLNIAYDVTYSLA CVRCCVNPFLYAFIGVKFRNDLFKLFKDLGCLSQEQLRQWSSCRHIRR SSMSVEAETTTTFSP |
| 45 | CXCR5 | MNYPLTLEMDLENLEDLFWELDRLDNYNDTSLVENHLCPATEGPLM ASFKAVFVPVAYSLIFLLGVIGNVLVLVILERHRQTRSSTETFLFHLAV ADLLLVFILPFAVAEGSVGWVLGTFLCKTVIALHKVNFYCSSLLLACI AVDRYLAIVHAVHAYRHRRLLSIHITCGTIWLVGFLLALPEILFAKVS QGHHNNSLPRCTFSQENQAETHAWFTSRFLYHVAGFLLPMLVMGWC YVGVVHRLRQAQRRPQRQKAVRVAILVTSIFFLCWSPYHIVIFLDTLA RLKAVDNTCKLNGSLPVAITMCEFLGLAHCCLNPMLYTFAGVKFRSD LSRLLTKLGCTGPASLCQLFPSWRRSSLSESENATSLTTF |
| 46 | GPR119 | MESSFSFGVILAVLASLIIATNTLVAVAVLLLIHKNDGVSLCFTLNLAV ADTLIGVAISGLLTDQLSSPSRPTQKTLCSLRMAFVTSSAAASVLTVM LITFDRYLAIKQPFRYLKIMSGFVAGACIAGLWLVSYLIGFLPLGIPMF QQTAYKGQCSFFAVFHPHFVLTLSCVGFFPAMLLFVFFYCDMLKIAS MHSQQIRKMEHAGAMAGGYRSPRTPSDFKALRTVSVLIGSFALSWTP FLITGIVQVACQECHLYLVLERYLWLLGVGNSLLNPLIYAYWQKEVR LQLYHMALGVKKVLTSFLLFLSARNCGPERPRESSCHIVTISSSEFDG |
| 47 | GPR55 | MSQQNTSGDCLFDGVNELMKTLQFAVHIPTFVLGLLLNLLAIHGFSTF LKNRWPDYAATSIYMINLAVFDLLLVLSLPFKMVLSQVQSPFPSLCTL VECLYFVSMYGSVFTICFISMDRFLAIRYPLLVSHLRSPRKIFGICCTIW VLVWTGSIPIYSFHGKVEKYMCFHNMSDDTWSAKVFFPLEVFGFLLP MGIMGFCCSRSIHILLGRRDHTQDWVQQKACIYSIAASLAVFVVSFLP VHLGFFLQFLVRNSFIVECRAKQSISFFLQLSMCFSNVNCCLDVFCYYF VIKEFRMNIRAHRPSRVQLVLQDTTISRG |

Provided herein are scaffolds comprising GPCR binding domains, wherein the sequences of the GPCR binding domains support interaction with at least one GPCR. The sequence may be homologous or identical to a sequence of a GPCR ligand. In some instances, the GPCR binding domain sequence comprises at least or about 70%, 80%, 85%, 90%, 91%, 92%, 93%, 94%, 95%, 96%, 97%, 98%, 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47. In some instances, the GPCR binding domain sequence comprises at least or about 95% homology to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47. In some instances, the GPCR binding domain sequence comprises at least or about 97% homology to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47. In some instances, the GPCR binding domain sequence comprises at least or about 99% homology to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47. In some instances, the GPCR binding domain sequence comprises at least or about 100% homology to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47. In some instances, the GPCR binding domain sequence comprises at least a portion having at least or about 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, or more than 400 amino acids of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47.

Libraries comprising nucleic acids encoding for scaffolds comprising GPCR binding domains may bind to one or more GPCRs. In some instances, the scaffolds comprising GPCR binding domains binds to a single GPCR. In some instances, the scaffolds comprising GPCR binding domains binds to GPCRs in a same family or class. In some instances, the scaffolds comprising GPCR binding domains bind to multiple GPCRs. For example, the scaffolds are multimeric and comprise at least 2 scaffolds. In some instances, the multimeric scaffolds comprise at least or about 3, 4, 5, 6, 7, 8, or more than 8 scaffolds. In some instances, the multimeric scaffolds comprise at least 2 scaffolds linked by, for example, a dimerization domain, an amino acid linker, a disulfide bond, a chemical crosslink, or any other linker known in the art. In some instances, the multimeric scaffolds bind to the same GPCRs or different GPCRs.

Provided herein are GPCR binding libraries comprising nucleic acids encoding for scaffolds comprising GPCR binding domains comprise variation in domain type, domain length, or residue variation. In some instances, the domain is a region in the scaffold comprising the GPCR binding domains. For example, the region is the VH, CDR-H3, or VL domain. In some instances, the domain is the GPCR binding domain.

Methods described herein provide for synthesis of a GPCR binding library of nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the GPCR binding library comprises varied nucleic acids collectively encoding variations at multiple positions. In some instances, the variant library comprises sequences encoding for variation of at least a single codon of a VH, CDR-H3, or VL domain. In some instances, the variant library comprises sequences encoding for variation of at least a single codon in a GPCR binding domain. For example, at least one single codon of a GPCR binding domain as listed in Table 2 is varied. In some instances, the variant library comprises sequences encoding for variation of multiple codons of a VH, CDR-H3, or VL domain. In some instances, the variant library comprises sequences encoding for variation of multiple codons in a GPCR binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of a GPCR binding library of nucleic acids each encoding for a predetermined variant of at least one predetermined reference nucleic acid sequence, wherein the GPCR binding library comprises sequences encoding for variation of length of a domain. In some instances, the domain is VH, CDR-H3, or VL domain. In some instances, the domain is the GPCR binding domain. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Provided herein are GPCR binding libraries comprising nucleic acids encoding for scaffolds comprising GPCR binding domains, wherein the GPCR binding libraries are synthesized with various numbers of fragments. In some instances, the fragments comprise the VH, CDR-H3, or VL domain. In some instances, the GPCR binding libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

GPCR binding libraries comprising nucleic acids encoding for scaffolds comprising GPCR binding domains as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 to about 75 amino acids.

Figure 2A:
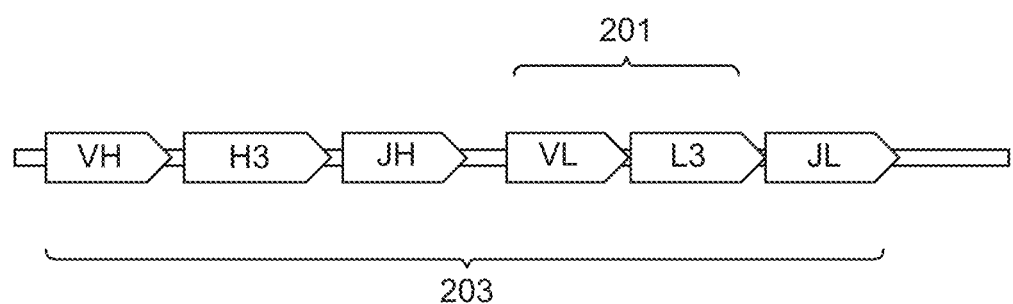
FIG. 2A depicts a first schematic of an immunoglobulin scaffold.
Figure 2B:
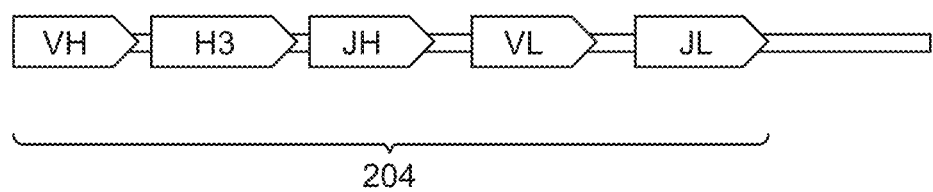
FIG. 2B depicts a second schematic of an immunoglobulin scaffold.

GPCR binding libraries comprising de novo synthesized variant sequences encoding for scaffolds comprising GPCR binding domains comprise a number of variant sequences. In some instances, a number of variant sequences is de novo synthesized for a CDR-H1, CDR-H2, CDR-H3, CDR-L1, CDR-L2, CDR-L3, VL, VH, or a combination thereof. In some instances, a number of variant sequences is de novo synthesized for framework element 1 (FW1), framework element 2 (FW2), framework element 3 (FW3), or framework element 4 (FW4). In some instances, a number of variant sequences is de novo synthesized for a GPCR binding domain. For example, the number of variant sequences is about 1 to about 10 sequences for the VH domain, about $10^8$ sequences for the GPCR binding domain, and about 1 to about 44 sequences for the VK domain. See FIG. 2. The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is about 10 to 300, 25 to 275, 50 to 250, 75 to 225, 100 to 200, or 125 to 150 sequences.

GPCR binding libraries comprising de novo synthesized variant sequences encoding for scaffolds comprising GPCR binding domains comprise improved diversity. For example, variants are generated by placing GPCR binding domain variants in immunoglobulin scaffold variants comprising N-terminal CDR-H3 variations and C-terminal CDR-H3 variations. In some instances, variants include affinity maturation variants. Alternatively or in combination, variants include variants in other regions of the immunoglobulin including, but not limited to, CDR-H1, CDR-H2, CDR-L1, CDR-L2, and CDR-L3. In some instances, the number of variants of the GPCR binding libraries is least or about $10^4$, $10^5$, $10^6$, $10^7$, $10^8$, $10^9$, $10^{10}$, or more than $10^{10}$ non-identical sequences. For example, a library comprising about 10 variant sequences for a VH region, about 237 variant sequences for a CDR-H3 region, and about 43 variant sequences for a VL and CDR-L3 region comprises $10^5$ non-identical sequences (10×237×43). See FIGS. 4A-4B.

Figure 3:
FIG. 3 depicts a schematic of a motif for placement in a scaffold.

Following synthesis of GPCR binding libraries comprising nucleic acids encoding scaffolds comprising GPCR binding domains, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. For example as seen in FIG. 3, the GPCR binding libraries comprises nucleic acids encoding scaffolds comprising GPCR binding domains with multiple tags such as GFP, FLAG, and Lucy as well as a DNA barcode. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

Expression Systems

Provided herein are libraries comprising nucleic acids encoding for scaffolds comprising GPCR binding domains, wherein the libraries have improved specificity, stability, expression, folding, or downstream activity. In some instances, libraries described herein are used for screening and analysis.

Provided herein are libraries comprising nucleic acids encoding for scaffolds comprising GPCR binding domains, wherein the nucleic acid libraries are used for screening and analysis. In some instances, screening and analysis comprises in vitro, in vivo, or ex vivo assays. Cells for screening include primary cells taken from living subjects or cell lines. Cells may be from prokaryotes (e.g., bacteria and fungi) or eukaryotes (e.g., animals and plants). Exemplary animal cells include, without limitation, those from a mouse, rabbit, primate, and insect. In some instances, cells for screening include a cell line including, but not limited to, Chinese Hamster Ovary (CHO) cell line, human embryonic kidney (HEK) cell line, or baby hamster kidney (BHK) cell line. In some instances, nucleic acid libraries described herein may also be delivered to a multicellular organism. Exemplary multicellular organisms include, without limitation, a plant, a mouse, rabbit, primate, and insect.

Nucleic acid libraries described herein may be screened for various pharmacological or pharmacokinetic properties. In some instances, the libraries are screened using in vitro assays, in vivo assays, or ex vivo assays. For example, in vitro pharmacological or pharmacokinetic properties that are screened include, but are not limited to, binding affinity, binding specificity, and binding avidity. Exemplary in vivo pharmacological or pharmacokinetic properties of libraries described herein that are screened include, but are not limited to, therapeutic efficacy, activity, preclinical toxicity properties, clinical efficacy properties, clinical toxicity properties, immunogenicity, potency, and clinical safety properties.

Provided herein are nucleic acid libraries, wherein the nucleic acid libraries may be expressed in a vector. Expression vectors for inserting nucleic acid libraries disclosed herein may comprise eukaryotic or prokaryotic expression vectors. Exemplary expression vectors include, without limitation, mammalian expression vectors: pSF-CMV-NEO-NH2-PPT-3XFLAG, pSF-CMV-NEO-COOH-3XFLAG, pSF-CMV-PURO-NH2-GST-TEV, pSF-OXB20-COOH-TEV-FLAG(R)-6His, pCEP4 pDEST27, pSF-CMV-Ub-KrYFP, pSF-CMV-FMDV-daGFP, pEFla-mCherry-N1 Vector, pEFla-tdTomato Vector, pSF-CMV-FMDV-Hygro, pSF-CMV-PGK-Puro, pMCP-tag(m), and pSF-CMV-PURO-NH2-CMYC; bacterial expression vectors: pSF-OXB20-BetaGal, pSF-OXB20-Fluc, pSF-OXB20, and pSF-Tac; plant expression vectors: pRI 101-AN DNA and pCambia2301; and yeast expression vectors: pTYB21 and pKLAC2, and insect vectors: pAc5.1N5-His A and pDEST8. In some instances, the vector is pcDNA3 or pcDNA3.1.

Described herein are nucleic acid libraries that are expressed in a vector to generate a construct comprising a scaffold comprising sequences of GPCR binding domains. In some instances, a size of the construct varies. In some instances, the construct comprises at least or about 500, 600, 700, 800, 900, 1000, 1100, 1300, 1400, 1500, 1600, 1700, 1800, 2000, 2400, 2600, 2800, 3000, 3200, 3400, 3600, 3800, 4000, 4200, 4400, 4600, 4800, 5000, 6000, 7000, 8000, 9000, 10000, or more than 10000 bases. In some instances, a the construct comprises a range of about 300 to 1,000, 300 to 2,000, 300 to 3,000, 300 to 4,000, 300 to 5,000, 300 to 6,000, 300 to 7,000, 300 to 8,000, 300 to 9,000, 300 to 10,000, 1,000 to 2,000, 1,000 to 3,000, 1,000 to 4,000, 1,000 to 5,000, 1,000 to 6,000, 1,000 to 7,000, 1,000 to 8,000, 1,000 to 9,000, 1,000 to 10,000, 2,000 to 3,000, 2,000 to 4,000, 2,000 to 5,000, 2,000 to 6,000, 2,000 to 7,000, 2,000 to 8,000, 2,000 to 9,000, 2,000 to 10,000, 3,000 to 4,000, 3,000 to 5,000, 3,000 to 6,000, 3,000 to 7,000, 3,000 to 8,000, 3,000 to 9,000, 3,000 to 10,000, 4,000 to 5,000, 4,000 to 6,000, 4,000 to 7,000, 4,000 to 8,000, 4,000 to 9,000, 4,000 to 10,000, 5,000 to 6,000, 5,000 to 7,000, 5,000 to 8,000, 5,000 to 9,000, 5,000 to 10,000, 6,000 to 7,000, 6,000 to 8,000, 6,000 to 9,000, 6,000 to 10,000, 7,000 to 8,000, 7,000 to 9,000, 7,000 to 10,000, 8,000 to 9,000, 8,000 to 10,000, or 9,000 to 10,000 bases.

Provided herein are libraries comprising nucleic acids encoding for scaffolds comprising GPCR binding domains, wherein the nucleic acid libraries are expressed in a cell. In some instances, the libraries are synthesized to express a reporter gene. Exemplary reporter genes include, but are not limited to, acetohydroxyacid synthase (AHAS), alkaline phosphatase (AP), beta galactosidase (LacZ), beta glucoronidase (GUS), chloramphenicol acetyltransferase (CAT), green fluorescent protein (GFP), red fluorescent protein (RFP), yellow fluorescent protein (YFP), cyan fluorescent protein (CFP), cerulean fluorescent protein, citrine fluorescent protein, orange fluorescent protein, cherry fluorescent protein, turquoise fluorescent protein, blue fluorescent protein, horseradish peroxidase (HRP), luciferase (Luc), nopaline synthase (NOS), octopine synthase (OCS), luciferase, and derivatives thereof. Methods to determine modulation of a reporter gene are well known in the art, and include, but are not limited to, fluorometric methods (e.g. fluorescence spectroscopy, Fluorescence Activated Cell Sorting (FACS), fluorescence microscopy), and antibiotic resistance determination.

Diseases and Disorders

Provided herein are GPCR binding libraries comprising nucleic acids encoding for scaffolds comprising GPCR binding domains may have therapeutic effects. In some instances, the GPCR binding libraries result in protein when translated that is used to treat a disease or disorder. In some instances, the protein is an immunoglobulin. In some instances, the protein is a peptidomimetic. Exemplary diseases include, but are not limited to, cancer, inflammatory diseases or disorders, a metabolic disease or disorder, a cardiovascular disease or disorder, a respiratory disease or disorder, pain, a digestive disease or disorder, a reproductive disease or disorder, an endocrine disease or disorder, or a neurological disease or disorder. In some instances, the cancer is a solid cancer or a hematologic cancer. In some instances, an inhibitor of GPCR glucagon like peptide 1 receptor (GLP1R) as described herein is used for treatment of a metabolic disorder. In some instances, an inhibitor of GPCR GLP1R as described herein is used for treatment of weight gain (or for inducing weight loss), treatment of obesity, or treatment of Type II diabetes. In some instances, the subject is a mammal. In some instances, the subject is a mouse, rabbit, dog, or human. Subjects treated by methods described herein may be infants, adults, or children. Pharmaceutical compositions comprising antibodies or antibody fragments as described herein may be administered intravenously or subcutaneously. In some instances, a pharmaceutical composition comprises an antibody or antibody fragment described herein comprising a CDR-H3 comprising a sequence of any one of SEQ ID NOS: 2420 to 2436. In further instances, the pharmaceutical composition is used for treatment of a metabolic disorder.

Variant Libraries

Codon Variation

Variant nucleic acid libraries described herein may comprise a plurality of nucleic acids, wherein each nucleic acid encodes for a variant codon sequence compared to a reference nucleic acid sequence. In some instances, each nucleic acid of a first nucleic acid population contains a variant at a single variant site. In some instances, the first nucleic acid population contains a plurality of variants at a single variant site such that the first nucleic acid population contains more than one variant at the same variant site. The first nucleic acid population may comprise nucleic acids collectively encoding multiple codon variants at the same variant site. The first nucleic acid population may comprise nucleic acids collectively encoding up to 19 or more codons at the same position. The first nucleic acid population may comprise nucleic acids collectively encoding up to 60 variant triplets at the same position, or the first nucleic acid population may comprise nucleic acids collectively encoding up to 61 different triplets of codons at the same position. Each variant may encode for a codon that results in a different amino acid during translation. Table 3 provides a listing of each codon possible (and the representative amino acid) for a variant site.

TABLE 3

List of codons and amino acids

| Amino Acids | One letter code | Three letter code | Codons | | | | | |
|---|---|---|---|---|---|---|---|---|
| Alanine | A | Ala | GCA | GCC | GCG | | GCT | |
| Cysteine | C | Cys | TGC | | | | TGT | |
| Aspartic acid | D | Asp | GAC | | | | GAT | |
| Glutamic acid | E | Glu | GAA | | | | GAG | |
| Phenylalanine | F | Phe | TTC | | | | TTT | |
| Glycine | G | Gly | GGA | GGC | GGG | | GGT | |
| Histidine | H | His | CAC | | | | CAT | |
| Isoleucine | I | Iso | ATA | ATC | | | ATT | |
| Lysine | K | Lys | AAA | | | | AAG | |

TABLE 3-continued

List of codons and amino acids

| Amino Acids | One letter code | Three letter code | Codons | | | | | |
|---|---|---|---|---|---|---|---|---|
| Leucine | L | Leu | TTA | TTG | CTA | CTC | CTG | CTT |
| Methionine | M | Met | | | ATG | | | |
| Asparagine | N | Asn | AAC | | | | AAT | |
| Proline | P | Pro | CCA | CCC | CCG | | CCT | |
| Glutamine | Q | Gln | CAA | | | CAG | | |
| Arginine | R | Arg | AGA | AGG | CGA | CGC | CGG | CGT |
| Serine | S | Ser | AGC | AGT | TCA | TCC | TCG | TCT |
| Threonine | T | Thr | ACA | ACC | ACG | | ACT | |
| Valine | V | Val | GTA | GTC | GTG | | GTT | |
| Tryptophan | W | Trp | | | TGG | | | |
| Tyrosine | Y | Tyr | TAC | | | | TAT | |

A nucleic acid population may comprise varied nucleic acids collectively encoding up to 20 codon variations at multiple positions. In such cases, each nucleic acid in the population comprises variation for codons at more than one position in the same nucleic acid. In some instances, each nucleic acid in the population comprises variation for codons at 1, 2, 3, 4, 5, 6, 7, 8, 9, 10, 11, 12, 13, 14, 15, 16, 17, 18, 19, 20 or more codons in a single nucleic acid. In some instances, each variant long nucleic acid comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single long nucleic acid. In some instances, the variant nucleic acid population comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single nucleic acid. In some instances, the variant nucleic acid population comprises variation for codons in at least about 10, 20, 30, 40, 50, 60, 70, 80, 90, 100 or more codons in a single long nucleic acid.

Highly Parallel Nucleic Acid Synthesis

Provided herein is a platform approach utilizing miniaturization, parallelization, and vertical integration of the end-to-end process from polynucleotide synthesis to gene assembly within nanowells on silicon to create a revolutionary synthesis platform. Devices described herein provide, with the same footprint as a 96-well plate, a silicon synthesis platform is capable of increasing throughput by a factor of up to 1,000 or more compared to traditional synthesis methods, with production of up to approximately 1,000,000 or more polynucleotides, or 10,000 or more genes in a single highly-parallelized run.

With the advent of next-generation sequencing, high resolution genomic data has become an important factor for studies that delve into the biological roles of various genes in both normal biology and disease pathogenesis. At the core of this research is the central dogma of molecular biology and the concept of "residue-by-residue transfer of sequential information." Genomic information encoded in the DNA is transcribed into a message that is then translated into the protein that is the active product within a given biological pathway.

Another exciting area of study is on the discovery, development and manufacturing of therapeutic molecules focused on a highly-specific cellular target. High diversity DNA sequence libraries are at the core of development pipelines for targeted therapeutics. Gene mutants are used to express proteins in a design, build, and test protein engineering cycle that ideally culminates in an optimized gene for high expression of a protein with high affinity for its therapeutic target. As an example, consider the binding pocket of a receptor.

The ability to test all sequence permutations of all residues within the binding pocket simultaneously will allow for a thorough exploration, increasing chances of success. Saturation mutagenesis, in which a researcher attempts to generate all possible mutations at a specific site within the receptor, represents one approach to this development challenge. Though costly and time and labor-intensive, it enables each variant to be introduced into each position. In contrast, combinatorial mutagenesis, where a few selected positions or short stretch of DNA may be modified extensively, generates an incomplete repertoire of variants with biased representation.

To accelerate the drug development pipeline, a library with the desired variants available at the intended frequency in the right position available for testing—in other words, a precision library, enables reduced costs as well as turn-around time for screening. Provided herein are methods for synthesizing nucleic acid synthetic variant libraries which provide for precise introduction of each intended variant at the desired frequency. To the end user, this translates to the ability to not only thoroughly sample sequence space but also be able to query these hypotheses in an efficient manner, reducing cost and screening time. Genome-wide editing can elucidate important pathways, libraries where each variant and sequence permutation can be tested for optimal functionality, and thousands of genes can be used to reconstruct entire pathways and genomes to re-engineer biological systems for drug discovery.

In a first example, a drug itself can be optimized using methods described herein. For example, to improve a specified function of an antibody, a variant polynucleotide library encoding for a portion of the antibody is designed and synthesized. A variant nucleic acid library for the antibody can then be generated by processes described herein (e.g., PCR mutagenesis followed by insertion into a vector). The antibody is then expressed in a production cell line and screened for enhanced activity. Example screens include examining modulation in binding affinity to an antigen, stability, or effector function (e.g., ADCC, complement, or apoptosis). Exemplary regions to optimize the antibody include, without limitation, the Fc region, Fab region, variable region of the Fab region, constant region of the Fab region, variable domain of the heavy chain or light chain ($V_H$ or $V_L$), and specific complementarity-determining regions (CDRs) of $V_H$ or $V_L$.

Nucleic acid libraries synthesized by methods described herein may be expressed in various cells associated with a disease state. Cells associated with a disease state include cell lines, tissue samples, primary cells from a subject, cultured cells expanded from a subject, or cells in a model system. Exemplary model systems include, without limitation, plant and animal models of a disease state.

To identify a variant molecule associated with prevention, reduction or treatment of a disease state, a variant nucleic acid library described herein is expressed in a cell associated with a disease state, or one in which a cell a disease state can be induced. In some instances, an agent is used to induce a disease state in cells. Exemplary tools for disease state induction include, without limitation, a Cre/Lox recombination system, LPS inflammation induction, and streptozotocin to induce hypoglycemia. The cells associated with a disease state may be cells from a model system or cultured cells, as well as cells from a subject having a particular disease condition. Exemplary disease conditions include a bacterial, fungal, viral, autoimmune, or proliferative disorder (e.g., cancer). In some instances, the variant nucleic acid library is expressed in the model system, cell line, or primary cells derived from a subject, and screened for changes in at least one cellular activity. Exemplary cellular activities include, without limitation, proliferation, cycle progression, cell death, adhesion, migration, reproduction, cell signaling, energy production, oxygen utilization, metabolic activity, and aging, response to free radical damage, or any combination thereof.

Substrates

Devices used as a surface for polynucleotide synthesis may be in the form of substrates which include, without limitation, homogenous array surfaces, patterned array surfaces, channels, beads, gels, and the like. Provided herein are substrates comprising a plurality of clusters, wherein each cluster comprises a plurality of loci that support the attachment and synthesis of polynucleotides. In some instances, substrates comprise a homogenous array surface. For example, the homogenous array surface is a homogenous plate. The term "locus" as used herein refers to a discrete region on a structure which provides support for polynucleotides encoding for a single predetermined sequence to extend from the surface. In some instances, a locus is on a two dimensional surface, e.g., a substantially planar surface. In some instances, a locus is on a three-dimensional surface, e.g., a well, microwell, channel, or post. In some instances, a surface of a locus comprises a material that is actively functionalized to attach to at least one nucleotide for polynucleotide synthesis, or preferably, a population of identical nucleotides for synthesis of a population of polynucleotides. In some instances, polynucleotide refers to a population of polynucleotides encoding for the same nucleic acid sequence. In some cases, a surface of a substrate is inclusive of one or a plurality of surfaces of a substrate. The average error rates for polynucleotides synthesized within a library described here using the systems and methods provided are often less than 1 in 1000, less than about 1 in 2000, less than about 1 in 3000 or less often without error correction.

Provided herein are surfaces that support the parallel synthesis of a plurality of polynucleotides having different predetermined sequences at addressable locations on a common support. In some instances, a substrate provides support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more non-identical polynucleotides. In some cases, the surfaces provide support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more polynucleotides encoding for distinct sequences. In some instances, at least a portion of the polynucleotides have an identical sequence or are configured to be synthesized with an identical sequence. In some instances, the substrate provides a surface environment for the growth of polynucleotides having at least 80, 90, 100, 120, 150, 175, 200, 225, 250, 275, 300, 325, 350, 375, 400, 425, 450, 475, 500 bases or more.

Provided herein are methods for polynucleotide synthesis on distinct loci of a substrate, wherein each locus supports the synthesis of a population of polynucleotides. In some cases, each locus supports the synthesis of a population of polynucleotides having a different sequence than a population of polynucleotides grown on another locus. In some instances, each polynucleotide sequence is synthesized with 1, 2, 3, 4, 5, 6, 7, 8, 9 or more redundancy across different loci within the same cluster of loci on a surface for polynucleotide synthesis. In some instances, the loci of a substrate are located within a plurality of clusters. In some instances, a substrate comprises at least 10, 500, 1000, 2000, 3000, 4000, 5000, 6000, 7000, 8000, 9000, 10000, 11000, 12000, 13000, 14000, 15000, 20000, 30000, 40000, 50000 or more clusters. In some instances, a substrate comprises more than 2,000; 5,000; 10,000; 100,000; 200,000; 300,000; 400,000; 500,000; 600,000; 700,000; 800,000; 900,000; 1,000,000; 1,100,000; 1,200,000; 1,300,000; 1,400,000; 1,500,000; 1,600,000; 1,700,000; 1,800,000; 1,900,000; 2,000,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; or 10,000,000 or more distinct loci. In some instances, a substrate comprises about 10,000 distinct loci. The amount of loci within a single cluster is varied in different instances. In some cases, each cluster includes 1, 2, 3, 4, 5, 6, 7, 8, 9, 10, 20, 30, 40, 50, 60, 70, 80, 90, 100, 120, 130, 150, 200, 300, 400, 500 or more loci. In some instances, each cluster includes about 50-500 loci. In some instances, each cluster includes about 100-200 loci. In some instances, each cluster includes about 100-150 loci. In some instances, each cluster includes about 109, 121, 130 or 137 loci. In some instances, each cluster includes about 19, 20, 61, 64 or more loci. Alternatively or in combination, polynucleotide synthesis occurs on a homogenous array surface.

In some instances, the number of distinct polynucleotides synthesized on a substrate is dependent on the number of distinct loci available in the substrate. In some instances, the density of loci within a cluster or surface of a substrate is at least or about 1, 10, 25, 50, 65, 75, 100, 130, 150, 175, 200, 300, 400, 500, 1,000 or more loci per $mm^2$. In some cases, a substrate comprises 10-500, 25-400, 50-500, 100-500, 150-500, 10-250, 50-250, 10-200, or 50-200 $mm^2$. In some instances, the distance between the centers of two adjacent loci within a cluster or surface is from about 10-500, from about 10-200, or from about 10-100 um. In some instances, the distance between two centers of adjacent loci is greater than about 10, 20, 30, 40, 50, 60, 70, 80, 90 or 100 um. In some instances, the distance between the centers of two adjacent loci is less than about 200, 150, 100, 80, 70, 60, 50, 40, 30, 20 or 10 um. In some instances, each locus has a width of about 0.5, 1, 2, 3, 4, 5, 6, 7, 8, 9, 10, 20, 30, 40, 50, 60, 70, 80, 90 or 100 um. In some cases, each locus is has a width of about 0.5-100, 0.5-50, 10-75, or 0.5-50 um.

In some instances, the density of clusters within a substrate is at least or about 1 cluster per 100 $mm^2$, 1 cluster per 10 $mm^2$, 1 cluster per 5 $mm^2$, 1 cluster per 4 $mm^2$, 1 cluster per 3 $mm^2$, 1 cluster per 2 $mm^2$, 1 cluster per 1 $mm^2$, 2 clusters per 1 $mm^2$, 3 clusters per 1 $mm^2$, 4 clusters per 1 $mm^2$, 5 clusters per 1 $mm^2$, 10 clusters per 1 $mm^2$, 50 clusters per 1 $mm^2$ or more. In some instances, a substrate comprises from about 1 cluster per 10 $mm^2$ to about 10 clusters per 1 $mm^2$. In some instances, the distance between the centers of two adjacent clusters is at least or about 50, 100, 200, 500, 1000, 2000, or 5000 um. In some cases, the distance between the centers of two adjacent clusters is between about 50-100, 50-200, 50-300, 50-500, and 100-2000 um. In some cases, the distance between the centers of two adjacent clusters is between about 0.05-50, 0.05-10, 0.05-5, 0.05-4, 0.05-3, 0.05-2, 0.1-10, 0.2-10, 0.3-10, 0.4-10, 0.5-10, 0.5-5, or 0.5-2 mm. In some cases, each cluster has a cross section of about 0.5 to about 2, about 0.5 to about 1, or about 1 to about 2 mm. In some cases, each cluster has a cross section of about 0.5, 0.6, 0.7, 0.8, 0.9, 1, 1.1, 1.2, 1.3, 1.4, 1.5, 1.6, 1.7, 1.8, 1.9 or 2 mm. In some cases, each cluster has an interior cross section of about 0.5, 0.6, 0.7, 0.8, 0.9, 1, 1.1, 1.15, 1.2, 1.3, 1.4, 1.5, 1.6, 1.7, 1.8, 1.9 or 2 mm.

In some instances, a substrate is about the size of a standard 96 well plate, for example between about 100 and about 200 mm by between about 50 and about 150 mm. In some instances, a substrate has a diameter less than or equal to about 1000, 500, 450, 400, 300, 250, 200, 150, 100 or 50 mm. In some instances, the diameter of a substrate is between about 25-1000, 25-800, 25-600, 25-500, 25-400, 25-300, or 25-200 mm. In some instances, a substrate has a planar surface area of at least about 100; 200; 500; 1,000; 2,000; 5,000; 10,000; 12,000; 15,000; 20,000; 30,000; 40,000; 50,000 $mm^2$ or more. In some instances, the thickness of a substrate is between about 50-2000, 50-1000, 100-1000, 200-1000, or 250-1000 mm.

Surface Materials

Substrates, devices, and reactors provided herein are fabricated from any variety of materials suitable for the methods, compositions, and systems described herein. In certain instances, substrate materials are fabricated to exhibit a low level of nucleotide binding. In some instances, substrate materials are modified to generate distinct surfaces that exhibit a high level of nucleotide binding. In some instances, substrate materials are transparent to visible and/or UV light. In some instances, substrate materials are sufficiently conductive, e.g., are able to form uniform electric fields across all or a portion of a substrate. In some instances, conductive materials are connected to an electric ground. In some instances, the substrate is heat conductive or insulated. In some instances, the materials are chemical resistant and heat resistant to support chemical or biochemical reactions, for example polynucleotide synthesis reaction processes. In some instances, a substrate comprises flexible materials. For flexible materials, materials can include, without limitation: nylon, both modified and unmodified, nitrocellulose, polypropylene, and the like. In some instances, a substrate comprises rigid materials. For rigid materials, materials can include, without limitation: glass; fuse silica; silicon, plastics (for example polytetraflouroethylene, polypropylene, polystyrene, polycarbonate, and blends thereof, and the like); metals (for example, gold, platinum, and the like). The substrate, solid support or reactors can be fabricated from a material selected from the group consisting of silicon, polystyrene, agarose, dextran, cellulosic polymers, polyacrylamides, polydimethylsiloxane (PDMS), and glass. The substrates/solid supports or the microstructures, reactors therein may be manufactured with a combination of materials listed herein or any other suitable material known in the art.

Surface Architecture

Provided herein are substrates for the methods, compositions, and systems described herein, wherein the substrates have a surface architecture suitable for the methods, compositions, and systems described herein. In some instances, a substrate comprises raised and/or lowered features. One benefit of having such features is an increase in surface area to support polynucleotide synthesis. In some instances, a substrate having raised and/or lowered features is referred to as a three-dimensional substrate. In some cases, a three-dimensional substrate comprises one or more channels. In some cases, one or more loci comprise a channel. In some cases, the channels are accessible to reagent deposition via a deposition device such as a material deposition device. In some cases, reagents and/or fluids collect in a larger well in fluid communication one or more channels. For example, a substrate comprises a plurality of channels corresponding to a plurality of loci with a cluster, and the plurality of channels are in fluid communication with one well of the cluster. In some methods, a library of polynucleotides is synthesized in a plurality of loci of a cluster.

Provided herein are substrates for the methods, compositions, and systems described herein, wherein the substrates are configured for polynucleotide synthesis. In some instances, the structure is configured to allow for controlled flow and mass transfer paths for polynucleotide synthesis on a surface. In some instances, the configuration of a substrate allows for the controlled and even distribution of mass transfer paths, chemical exposure times, and/or wash efficacy during polynucleotide synthesis. In some instances, the configuration of a substrate allows for increased sweep efficiency, for example by providing sufficient volume for a growing polynucleotide such that the excluded volume by the growing polynucleotide does not take up more than 50, 45, 40, 35, 30, 25, 20, 15, 14, 13, 12, 11, 10, 9, 8, 7, 6, 5, 4, 3, 2, 1%, or less of the initially available volume that is available or suitable for growing the polynucleotide. In some instances, a three-dimensional structure allows for managed flow of fluid to allow for the rapid exchange of chemical exposure.

Provided herein are substrates for the methods, compositions, and systems described herein, wherein the substrates comprise structures suitable for the methods, compositions, and systems described herein. In some instances, segregation is achieved by physical structure. In some instances, segregation is achieved by differential functionalization of the surface generating active and passive regions for polynucleotide synthesis. In some instances, differential functionalization is achieved by alternating the hydrophobicity across the substrate surface, thereby creating water contact angle effects that cause beading or wetting of the deposited reagents. Employing larger structures can decrease splashing and cross-contamination of distinct polynucleotide synthesis locations with reagents of the neighboring spots. In some cases, a device, such as a material deposition device, is used to deposit reagents to distinct polynucleotide synthesis locations. Substrates having three-dimensional features are configured in a manner that allows for the synthesis of a large number of polynucleotides (e.g., more than about 10,000) with a low error rate (e.g., less than about 1:500, 1:1000, 1:1500, 1:2,000, 1:3,000, 1:5,000, or 1:10,000). In some cases, a substrate comprises features with a density of about or greater than about 1, 5, 10, 20, 30, 40, 50, 60, 70, 80, 100, 110, 120, 130, 140, 150, 160, 170, 180, 190, 200, 300, 400 or 500 features per $mm^2$.

A well of a substrate may have the same or different width, height, and/or volume as another well of the substrate. A channel of a substrate may have the same or different width, height, and/or volume as another channel of the substrate. In some instances, the diameter of a cluster or the diameter of a well comprising a cluster, or both, is between about 0.05-50, 0.05-10, 0.05-5, 0.05-4, 0.05-3, 0.05-2, 0.05-1, 0.05-0.5, 0.05-0.1, 0.1-10, 0.2-10, 0.3-10, 0.4-10, 0.5-10, 0.5-5, or 0.5-2 mm. In some instances, the diameter of a cluster or well or both is less than or about 5, 4, 3, 2, 1, 0.5, 0.1, 0.09, 0.08, 0.07, 0.06, or 0.05 mm. In some instances, the diameter of a cluster or well or both is between about 1.0 and 1.3 mm. In some instances, the diameter of a cluster or well, or both is about 1.150 mm. In some instances, the diameter of a cluster or well, or both is about 0.08 mm. The diameter of a cluster refers to clusters within a two-dimensional or three-dimensional substrate.

In some instances, the height of a well is from about 20-1000, 50-1000, 100-1000, 200-1000, 300-1000, 400-1000, or 500-1000 um. In some cases, the height of a well is less than about 1000, 900, 800, 700, or 600 um.

In some instances, a substrate comprises a plurality of channels corresponding to a plurality of loci within a cluster, wherein the height or depth of a channel is 5-500, 5-400, 5-300, 5-200, 5-100, 5-50, or 10-50 um. In some cases, the height of a channel is less than 100, 80, 60, 40, or 20 um.

In some instances, the diameter of a channel, locus (e.g., in a substantially planar substrate) or both channel and locus (e.g., in a three-dimensional substrate wherein a locus corresponds to a channel) is from about 1-1000, 1-500, 1-200, 1-100, 5-100, or 10-100 um, for example, about 90, 80, 70, 60, 50, 40, 30, 20 or 10 um. In some instances, the diameter of a channel, locus, or both channel and locus is less than about 100, 90, 80, 70, 60, 50, 40, 30, 20 or 10 um. In some instances, the distance between the center of two adjacent channels, loci, or channels and loci is from about 1-500, 1-200, 1-100, 5-200, 5-100, 5-50, or 5-30, for example, about 20 um.

Surface Modifications

Provided herein are methods for polynucleotide synthesis on a surface, wherein the surface comprises various surface modifications. In some instances, the surface modifications are employed for the chemical and/or physical alteration of a surface by an additive or subtractive process to change one or more chemical and/or physical properties of a substrate surface or a selected site or region of a substrate surface. For example, surface modifications include, without limitation, (1) changing the wetting properties of a surface, (2) functionalizing a surface, i.e., providing, modifying or substituting surface functional groups, (3) defunctionalizing a surface, i.e., removing surface functional groups, (4) otherwise altering the chemical composition of a surface, e.g., through etching, (5) increasing or decreasing surface roughness, (6) providing a coating on a surface, e.g., a coating that exhibits wetting properties that are different from the wetting properties of the surface, and/or (7) depositing particulates on a surface.

In some cases, the addition of a chemical layer on top of a surface (referred to as adhesion promoter) facilitates structured patterning of loci on a surface of a substrate. Exemplary surfaces for application of adhesion promotion include, without limitation, glass, silicon, silicon dioxide and silicon nitride. In some cases, the adhesion promoter is a chemical with a high surface energy. In some instances, a second chemical layer is deposited on a surface of a substrate. In some cases, the second chemical layer has a low surface energy. In some cases, surface energy of a chemical layer coated on a surface supports localization of droplets on the surface. Depending on the patterning arrangement selected, the proximity of loci and/or area of fluid contact at the loci are alterable.

In some instances, a substrate surface, or resolved loci, onto which nucleic acids or other moieties are deposited, e.g., for polynucleotide synthesis, are smooth or substantially planar (e.g., two-dimensional) or have irregularities, such as raised or lowered features (e.g., three-dimensional features). In some instances, a substrate surface is modified with one or more different layers of compounds. Such modification layers of interest include, without limitation, inorganic and organic layers such as metals, metal oxides, polymers, small organic molecules and the like.

In some instances, resolved loci of a substrate are functionalized with one or more moieties that increase and/or decrease surface energy. In some cases, a moiety is chemically inert. In some cases, a moiety is configured to support a desired chemical reaction, for example, one or more processes in a polynucleotide synthesis reaction. The surface energy, or hydrophobicity, of a surface is a factor for determining the affinity of a nucleotide to attach onto the surface. In some instances, a method for substrate functionalization comprises: (a) providing a substrate having a surface that comprises silicon dioxide; and (b) silanizing the surface using, a suitable silanizing agent described herein or otherwise known in the art, for example, an organofunctional alkoxysilane molecule. Methods and functionalizing agents are described in U.S. Pat. No. 5,474,796, which is herein incorporated by reference in its entirety.

In some instances, a substrate surface is functionalized by contact with a derivatizing composition that contains a mixture of silanes, under reaction conditions effective to couple the silanes to the substrate surface, typically via reactive hydrophilic moieties present on the substrate surface. Silanization generally covers a surface through self-assembly with organofunctional alkoxysilane molecules. A variety of siloxane functionalizing reagents can further be used as currently known in the art, e.g., for lowering or increasing surface energy. The organofunctional alkoxysilanes are classified according to their organic functions.

Polynucleotide Synthesis

Methods of the current disclosure for polynucleotide synthesis may include processes involving phosphoramidite chemistry. In some instances, polynucleotide synthesis comprises coupling a base with phosphoramidite. Polynucleotide synthesis may comprise coupling a base by deposition of phosphoramidite under coupling conditions, wherein the same base is optionally deposited with phosphoramidite more than once, i.e., double coupling. Polynucleotide synthesis may comprise capping of unreacted sites. In some instances, capping is optional. Polynucleotide synthesis may also comprise oxidation or an oxidation step or oxidation steps. Polynucleotide synthesis may comprise deblocking, detritylation, and sulfurization. In some instances, polynucleotide synthesis comprises either oxidation or sulfurization. In some instances, between one or each step during a polynucleotide synthesis reaction, the device is washed, for example, using tetrazole or acetonitrile. Time frames for any one step in a phosphoramidite synthesis method may be less than about 2 min, 1 min, 50 sec, 40 sec, 30 sec, 20 sec and 10 sec.

Polynucleotide synthesis using a phosphoramidite method may comprise a subsequent addition of a phosphoramidite building block (e.g., nucleoside phosphoramidite) to a growing polynucleotide chain for the formation of a phosphite triester linkage. Phosphoramidite polynucleotide synthesis proceeds in the 3' to 5' direction. Phosphoramidite polynucleotide synthesis allows for the controlled addition of one nucleotide to a growing nucleic acid chain per synthesis cycle. In some instances, each synthesis cycle comprises a coupling step. Phosphoramidite coupling involves the formation of a phosphite triester linkage between an activated nucleoside phosphoramidite and a nucleoside bound to the substrate, for example, via a linker. In some instances, the nucleoside phosphoramidite is provided to the device activated. In some instances, the nucleoside phosphoramidite is provided to the device with an activator. In some instances, nucleoside phosphoramidites are provided to the device in a 1.5, 2, 3, 4, 5, 6, 7, 8, 9, 10, 11, 12, 13, 14, 15, 16, 17, 18, 19, 20, 25, 30, 35, 40, 50, 60, 70, 80, 90, 100-fold excess or more over the substrate-bound nucleosides. In some instances, the addition of nucleoside phosphoramidite is performed in an anhydrous environment, for example, in anhydrous acetonitrile. Following addition of a nucleoside phosphoramidite, the device is optionally washed. In some instances, the coupling step is repeated one or more additional times, optionally with a wash step between nucleoside phosphoramidite additions to the substrate. In some instances, a polynucleotide synthesis method used herein comprises 1, 2, 3 or more sequential coupling steps. Prior to coupling, in many cases, the nucleoside bound to the device is de-protected by removal of a protecting group, where the protecting group functions to prevent polymerization. A common protecting group is 4,4'-dimethoxytrityl (DMT).

Following coupling, phosphoramidite polynucleotide synthesis methods optionally comprise a capping step. In a capping step, the growing polynucleotide is treated with a capping agent. A capping step is useful to block unreacted substrate-bound 5'-OH groups after coupling from further chain elongation, preventing the formation of polynucleotides with internal base deletions. Further, phosphoramidites activated with 1H-tetrazole may react, to a small extent, with the 06 position of guanosine. Without being bound by theory, upon oxidation with $I_2$/water, this side product, possibly via 06-N7 migration, may undergo depurination. The apurinic sites may end up being cleaved in the course of the final deprotection of the polynucleotide thus reducing the yield of the full-length product. The O6 modifications may be removed by treatment with the capping reagent prior to oxidation with $I_2$/water. In some instances, inclusion of a capping step during polynucleotide synthesis decreases the error rate as compared to synthesis without capping. As an example, the capping step comprises treating the substrate-bound polynucleotide with a mixture of acetic anhydride and 1-methylimidazole. Following a capping step, the device is optionally washed.

In some instances, following addition of a nucleoside phosphoramidite, and optionally after capping and one or more wash steps, the device bound growing nucleic acid is oxidized. The oxidation step comprises the phosphite triester is oxidized into a tetracoordinated phosphate triester, a protected precursor of the naturally occurring phosphate diester internucleoside linkage. In some instances, oxidation of the growing polynucleotide is achieved by treatment with iodine and water, optionally in the presence of a weak base (e.g., pyridine, lutidine, collidine). Oxidation may be carried out under anhydrous conditions using, e.g. tert-Butyl hydroperoxide or (1S)-(+)-(10-camphorsulfonyl)-oxaziridine (CSO). In some methods, a capping step is performed following oxidation. A second capping step allows for device drying, as residual water from oxidation that may persist can inhibit subsequent coupling. Following oxidation, the device and growing polynucleotide is optionally washed. In some instances, the step of oxidation is substituted with a sulfurization step to obtain polynucleotide phosphorothioates, wherein any capping steps can be performed after the sulfurization. Many reagents are capable of the efficient sulfur transfer, including but not limited to 3-(Dimethylaminomethylidene)amino)-3H-1,2,4-dithiazole-3-thione, DDTT, 3H-1,2-benzodithiol-3-one 1,1-dioxide, also known as Beaucage reagent, and N,N,N'N'-Tetraethylthiuram disulfide (TETD).

In order for a subsequent cycle of nucleoside incorporation to occur through coupling, the protected 5' end of the device bound growing polynucleotide is removed so that the primary hydroxyl group is reactive with a next nucleoside phosphoramidite. In some instances, the protecting group is DMT and deblocking occurs with trichloroacetic acid in dichloromethane. Conducting detritylation for an extended time or with stronger than recommended solutions of acids may lead to increased depurination of solid support-bound polynucleotide and thus reduces the yield of the desired full-length product. Methods and compositions of the disclosure described herein provide for controlled deblocking conditions limiting undesired depurination reactions. In some instances, the device bound polynucleotide is washed after deblocking. In some instances, efficient washing after deblocking contributes to synthesized polynucleotides having a low error rate.

Methods for the synthesis of polynucleotides typically involve an iterating sequence of the following steps: application of a protected monomer to an actively functionalized surface (e.g., locus) to link with either the activated surface, a linker or with a previously deprotected monomer; deprotection of the applied monomer so that it is reactive with a subsequently applied protected monomer; and application of another protected monomer for linking. One or more intermediate steps include oxidation or sulfurization. In some instances, one or more wash steps precede or follow one or all of the steps.

Methods for phosphoramidite-based polynucleotide synthesis comprise a series of chemical steps. In some instances, one or more steps of a synthesis method involve reagent cycling, where one or more steps of the method comprise application to the device of a reagent useful for the step. For example, reagents are cycled by a series of liquid deposition and vacuum drying steps. For substrates comprising three-dimensional features such as wells, microwells, channels and the like, reagents are optionally passed through one or more regions of the device via the wells and/or channels.

Methods and systems described herein relate to polynucleotide synthesis devices for the synthesis of polynucleotides. The synthesis may be in parallel. For example, at least or about at least 2, 3, 4, 5, 6, 7, 8, 9, 10, 11, 12, 13, 14, 15, 16, 17, 18, 19, 20, 21, 22, 23, 24, 25, 30, 35, 40, 45, 50, 100, 150, 200, 250, 300, 350, 400, 450, 500, 550, 600, 650, 700, 750, 800, 850, 900, 1000, 10000, 50000, 75000, 100000 or more polynucleotides can be synthesized in parallel. The total number polynucleotides that may be synthesized in parallel may be from 2-100000, 3-50000, 4-10000, 5-1000, 6-900, 7-850, 8-800, 9-750, 10-700, 11-650, 12-600, 13-550, 14-500, 15-450, 16-400, 17-350, 18-300, 19-250, 20-200, 21-150, 22-100, 23-50, 24-45, 25-40, 30-35. Those of skill in the art appreciate that the total number of polynucleotides synthesized in parallel may fall within any range bound by any of these values, for example 25-100. The total number of polynucleotides synthesized in parallel may fall within any range defined by any of the values serving as endpoints of the range. Total molar mass of polynucleotides synthesized within the device or the molar mass of each of the polynucleotides may be at least or at least about 10, 20, 30, 40, 50, 100, 250, 500, 750, 1000, 2000, 3000, 4000, 5000, 6000, 7000, 8000, 9000, 10000, 25000, 50000, 75000, 100000 picomoles, or more. The length of each of the polynucleotides or average length of the polynucleotides within the device may be at least or about at least 10, 15, 20, 25, 30, 35, 40, 45, 50, 100, 150, 200, 300, 400, 500 nucleotides, or more. The length of each of the polynucleotides or average length of the polynucleotides within the device may be at most or about at most 500, 400, 300, 200, 150, 100, 50, 45, 35, 30, 25, 20, 19, 18, 17, 16, 15, 14, 13, 12, 11, 10 nucleotides, or less. The length of each of the polynucleotides or average length of the polynucleotides within the device may fall from 10-500, 9-400, 11-300, 12-200, 13-150, 14-100, 15-50, 16-45, 17-40, 18-35, 19-25. Those of skill in the art appreciate that the length of each of the polynucleotides or average length of the polynucleotides within the device may fall within any range bound by any of these values, for example 100-300. The length of each of the polynucleotides or average length of the polynucleotides within the device may fall within any range defined by any of the values serving as endpoints of the range.

Methods for polynucleotide synthesis on a surface provided herein allow for synthesis at a fast rate. As an example, at least 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 70, 80, 90, 100, 125, 150, 175, 200 nucleotides per hour, or more are synthesized. Nucleotides include adenine, guanine, thymine, cytosine, uridine building blocks, or analogs/modified versions thereof. In some instances, libraries of polynucleotides are synthesized in parallel on substrate. For example, a device comprising about or at least about 100; 1,000; 10,000; 30,000; 75,000; 100,000; 1,000,000; 2,000,000; 3,000,000; 4,000,000; or 5,000,000 resolved loci is able to support the synthesis of at least the same number of distinct polynucleotides, wherein polynucleotide encoding a distinct sequence is synthesized on a resolved locus. In some instances, a library of polynucleotides is synthesized on a device with low error rates described herein in less than about three months, two months, one month, three weeks, 15, 14, 13, 12, 11, 10, 9, 8, 7, 6, 5, 4, 3, 2 days, 24 hours or less. In some instances, larger nucleic acids assembled from a polynucleotide library synthesized with low error rate using the substrates and methods described herein are prepared in less than about three months, two months, one month, three weeks, 15, 14, 13, 12, 11, 10, 9, 8, 7, 6, 5, 4, 3, 2 days, 24 hours or less.

In some instances, methods described herein provide for generation of a library of nucleic acids comprising variant nucleic acids differing at a plurality of codon sites. In some instances, a nucleic acid may have 1 site, 2 sites, 3 sites, 4 sites, 5 sites, 6 sites, 7 sites, 8 sites, 9 sites, 10 sites, 11 sites, 12 sites, 13 sites, 14 sites, 15 sites, 16 sites, 17 sites 18 sites, 19 sites, 20 sites, 30 sites, 40 sites, 50 sites, or more of variant codon sites.

In some instances, the one or more sites of variant codon sites may be adjacent. In some instances, the one or more sites of variant codon sites may not be adjacent and separated by 1, 2, 3, 4, 5, 6, 7, 8, 9, 10, or more codons.

In some instances, a nucleic acid may comprise multiple sites of variant codon sites, wherein all the variant codon sites are adjacent to one another, forming a stretch of variant codon sites. In some instances, a nucleic acid may comprise multiple sites of variant codon sites, wherein none the variant codon sites are adjacent to one another. In some instances, a nucleic acid may comprise multiple sites of variant codon sites, wherein some the variant codon sites are adjacent to one another, forming a stretch of variant codon sites, and some of the variant codon sites are not adjacent to one another.

Figure 7:
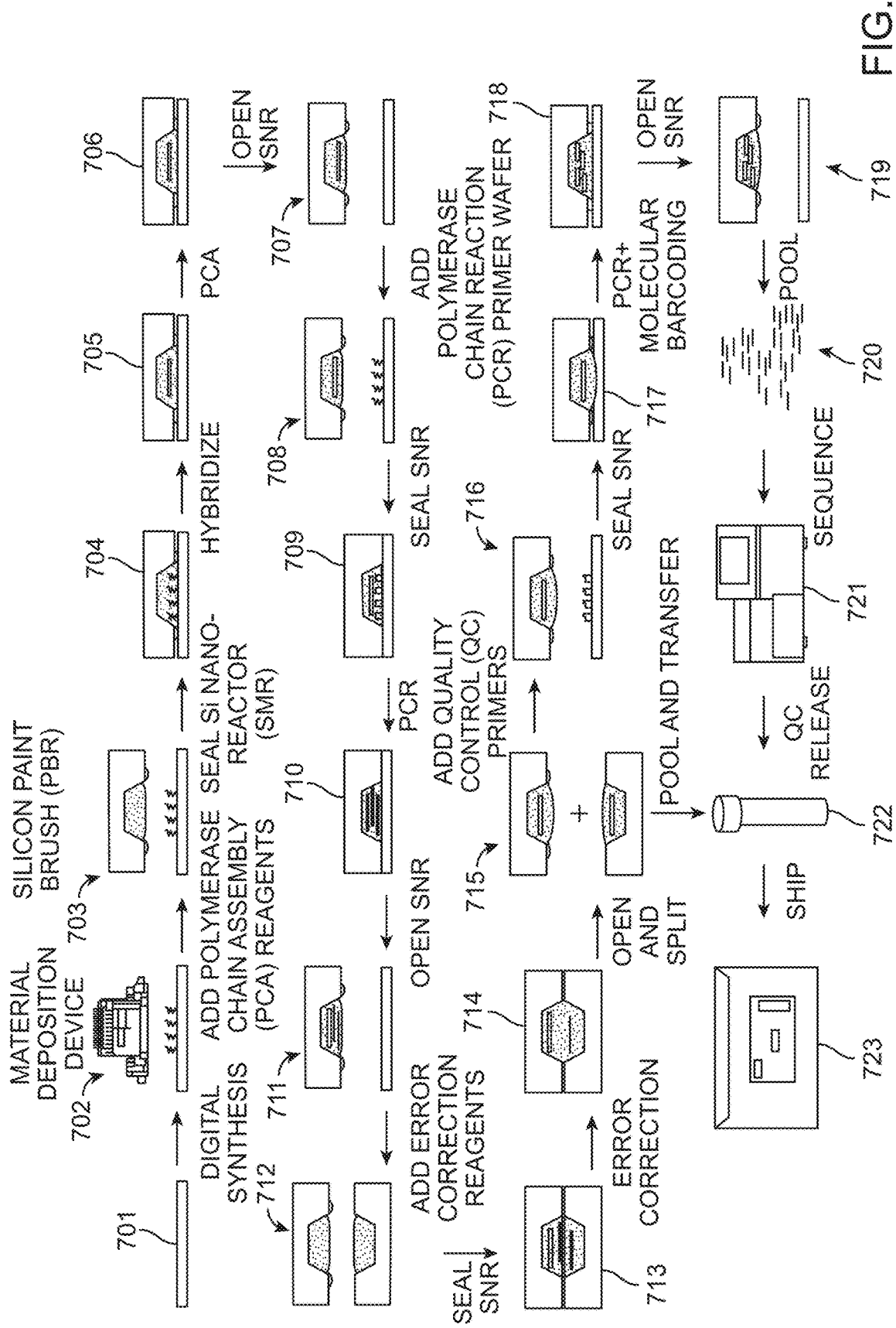
FIG. 7 presents a diagram of steps demonstrating an exemplary process workflow for gene synthesis as disclosed herein.

Referring to the Figures, FIG. 7 illustrates an exemplary process workflow for synthesis of nucleic acids (e.g., genes) from shorter nucleic acids. The workflow is divided generally into phases: (1) de novo synthesis of a single stranded nucleic acid library, (2) joining nucleic acids to form larger fragments, (3) error correction, (4) quality control, and (5) shipment. Prior to de novo synthesis, an intended nucleic acid sequence or group of nucleic acid sequences is preselected. For example, a group of genes is preselected for generation.

Once large nucleic acids for generation are selected, a predetermined library of nucleic acids is designed for de novo synthesis. Various suitable methods are known for generating high density polynucleotide arrays. In the workflow example, a device surface layer is provided. In the example, chemistry of the surface is altered in order to improve the polynucleotide synthesis process. Areas of low surface energy are generated to repel liquid while areas of high surface energy are generated to attract liquids. The surface itself may be in the form of a planar surface or contain variations in shape, such as protrusions or microwells which increase surface area. In the workflow example, high surface energy molecules selected serve a dual function of supporting DNA chemistry, as disclosed in International Patent Application Publication WO/2015/021080, which is herein incorporated by reference in its entirety.

In situ preparation of polynucleotide arrays is generated on a solid support and utilizes single nucleotide extension process to extend multiple oligomers in parallel. A deposition device, such as a material deposition device, is designed to release reagents in a step wise fashion such that multiple polynucleotides extend, in parallel, one residue at a time to generate oligomers with a predetermined nucleic acid sequence 702. In some instances, polynucleotides are cleaved from the surface at this stage. Cleavage includes gas cleavage, e.g., with ammonia or methylamine.

The generated polynucleotide libraries are placed in a reaction chamber. In this exemplary workflow, the reaction chamber (also referred to as "nanoreactor") is a silicon coated well, containing PCR reagents and lowered onto the polynucleotide library 703. Prior to or after the sealing 704 of the polynucleotides, a reagent is added to release the polynucleotides from the substrate. In the exemplary workflow, the polynucleotides are released subsequent to sealing of the nanoreactor 705. Once released, fragments of single stranded polynucleotides hybridize in order to span an entire long range sequence of DNA. Partial hybridization 705 is possible because each synthesized polynucleotide is designed to have a small portion overlapping with at least one other polynucleotide in the pool.

After hybridization, a PCA reaction is commenced. During the polymerase cycles, the polynucleotides anneal to complementary fragments and gaps are filled in by a polymerase. Each cycle increases the length of various fragments randomly depending on which polynucleotides find each other. Complementarity amongst the fragments allows for forming a complete large span of double stranded DNA 706.

After PCA is complete, the nanoreactor is separated from the device 707 and positioned for interaction with a device having primers for PCR 708. After sealing, the nanoreactor is subject to PCR 709 and the larger nucleic acids are amplified. After PCR 710, the nanochamber is opened 711, error correction reagents are added 712, the chamber is sealed 713 and an error correction reaction occurs to remove mismatched base pairs and/or strands with poor complementarity from the double stranded PCR amplification products 714. The nanoreactor is opened and separated 715. Error corrected product is next subject to additional processing steps, such as PCR and molecular bar coding, and then packaged 722 for shipment 723.

In some instances, quality control measures are taken. After error correction, quality control steps include for example interaction with a wafer having sequencing primers for amplification of the error corrected product 716, sealing the wafer to a chamber containing error corrected amplification product 717, and performing an additional round of amplification 718. The nanoreactor is opened 719 and the products are pooled 720 and sequenced 721. After an acceptable quality control determination is made, the packaged product 722 is approved for shipment 723.

In some instances, a nucleic acid generate by a workflow such as that in FIG. 7 is subject to mutagenesis using overlapping primers disclosed herein. In some instances, a library of primers are generated by in situ preparation on a solid support and utilize single nucleotide extension process to extend multiple oligomers in parallel. A deposition device, such as a material deposition device, is designed to release reagents in a step wise fashion such that multiple polynucleotides extend, in parallel, one residue at a time to generate oligomers with a predetermined nucleic acid sequence 702.

Computer Systems

Any of the systems described herein, may be operably linked to a computer and may be automated through a computer either locally or remotely. In various instances, the methods and systems of the disclosure may further comprise software programs on computer systems and use thereof. Accordingly, computerized control for the synchronization of the dispense/vacuum/refill functions such as orchestrating and synchronizing the material deposition device movement, dispense action and vacuum actuation are within the bounds of the disclosure. The computer systems may be programmed to interface between the user specified base sequence and the position of a material deposition device to deliver the correct reagents to specified regions of the substrate.

Figure 8:
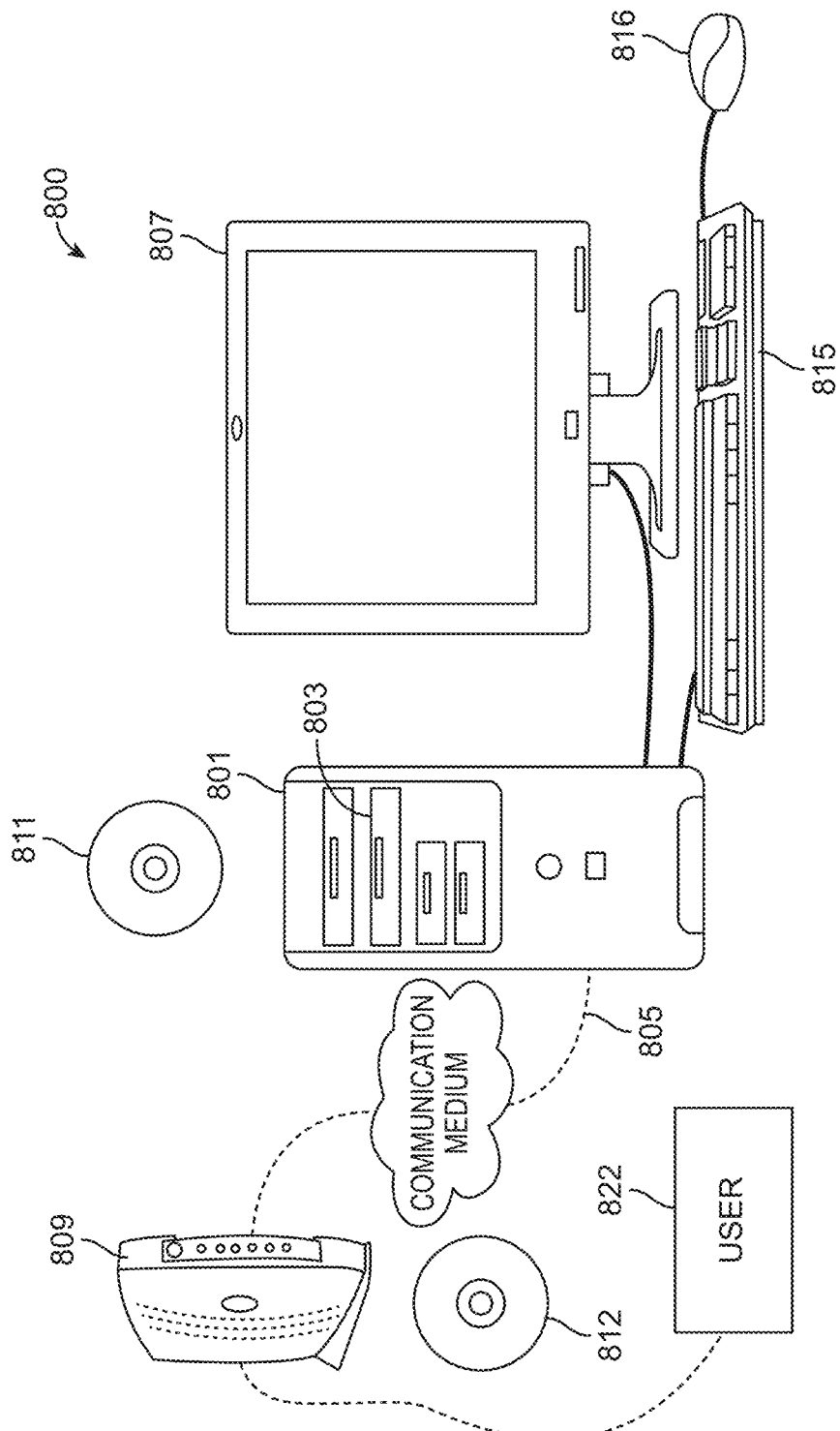
FIG. 8 illustrates an example of a computer system.

The computer system 800 illustrated in FIG. 8 may be understood as a logical apparatus that can read instructions from media 811 and/or a network port 805, which can optionally be connected to server 809 having fixed media 812. The system, such as shown in FIG. 8 can include a CPU 801, disk drives 803, optional input devices such as keyboard 815 and/or mouse 816 and optional monitor 807. Data communication can be achieved through the indicated communication medium to a server at a local or a remote location. The communication medium can include any means of transmitting and/or receiving data. For example, the communication medium can be a network connection, a wireless connection or an internet connection. Such a connection can provide for communication over the World Wide Web. It is envisioned that data relating to the present disclosure can be transmitted over such networks or connections for reception and/or review by a party 822 as illustrated in FIG. 8.

Figure 14:
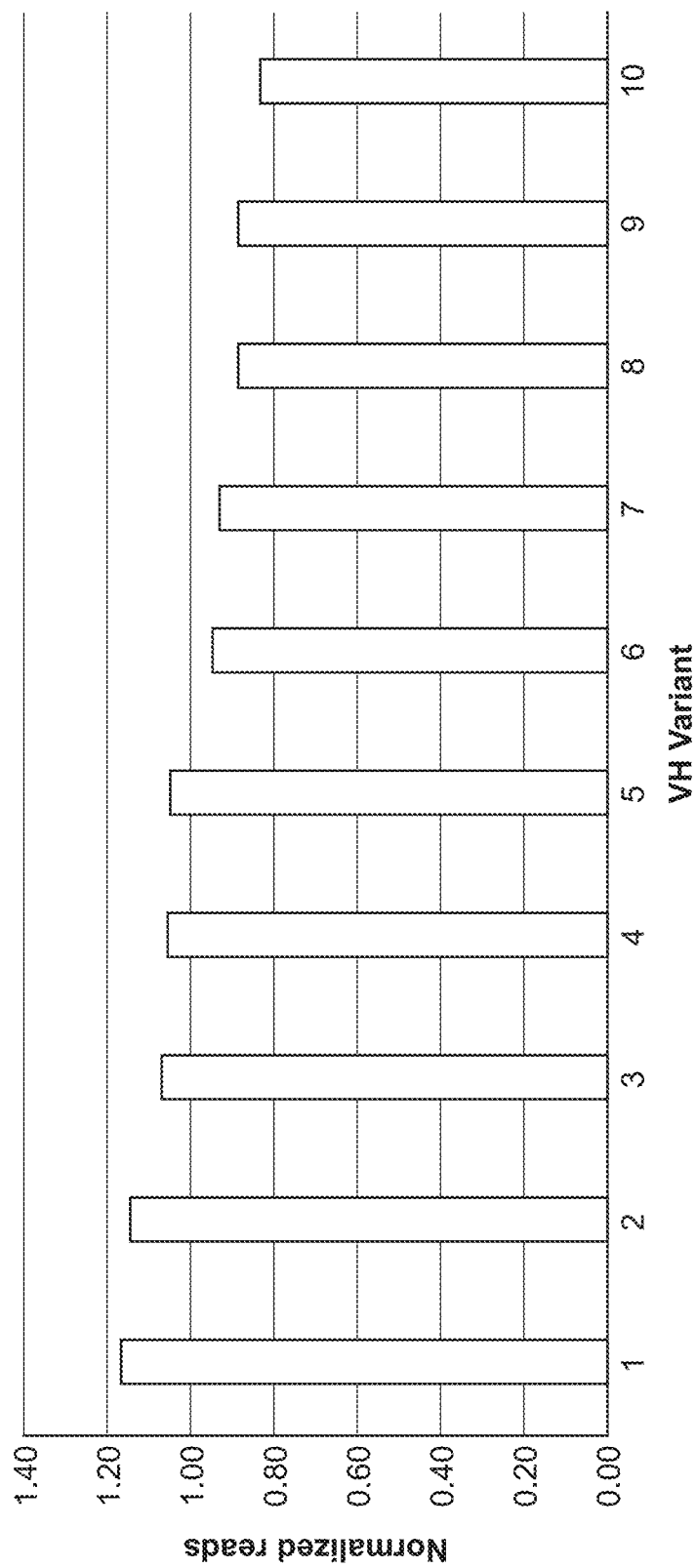
FIG. 14 is a graph of normalized reads for a library for variable domain, heavy chains.

FIG. 14 is a block diagram illustrating a first example architecture of a computer system 1400 that can be used in connection with example instances of the present disclosure. As depicted in FIG. 14, the example computer system can include a processor 1402 for processing instructions. Non-limiting examples of processors include: Intel Xeon™ processor, AMD Opteron™ processor, Samsung 32-bit RISC ARM 1176JZ(F)-S v1.0™ processor, ARM Cortex-A8 Samsung S5PC100™ processor, ARM Cortex-A8 Apple A4™ processor, Marvell PXA 930™ processor, or a functionally-equivalent processor. Multiple threads of execution can be used for parallel processing. In some instances, multiple processors or processors with multiple cores can also be used, whether in a single computer system, in a cluster, or distributed across systems over a network comprising a plurality of computers, cell phones, and/or personal data assistant devices.

Figure 9:
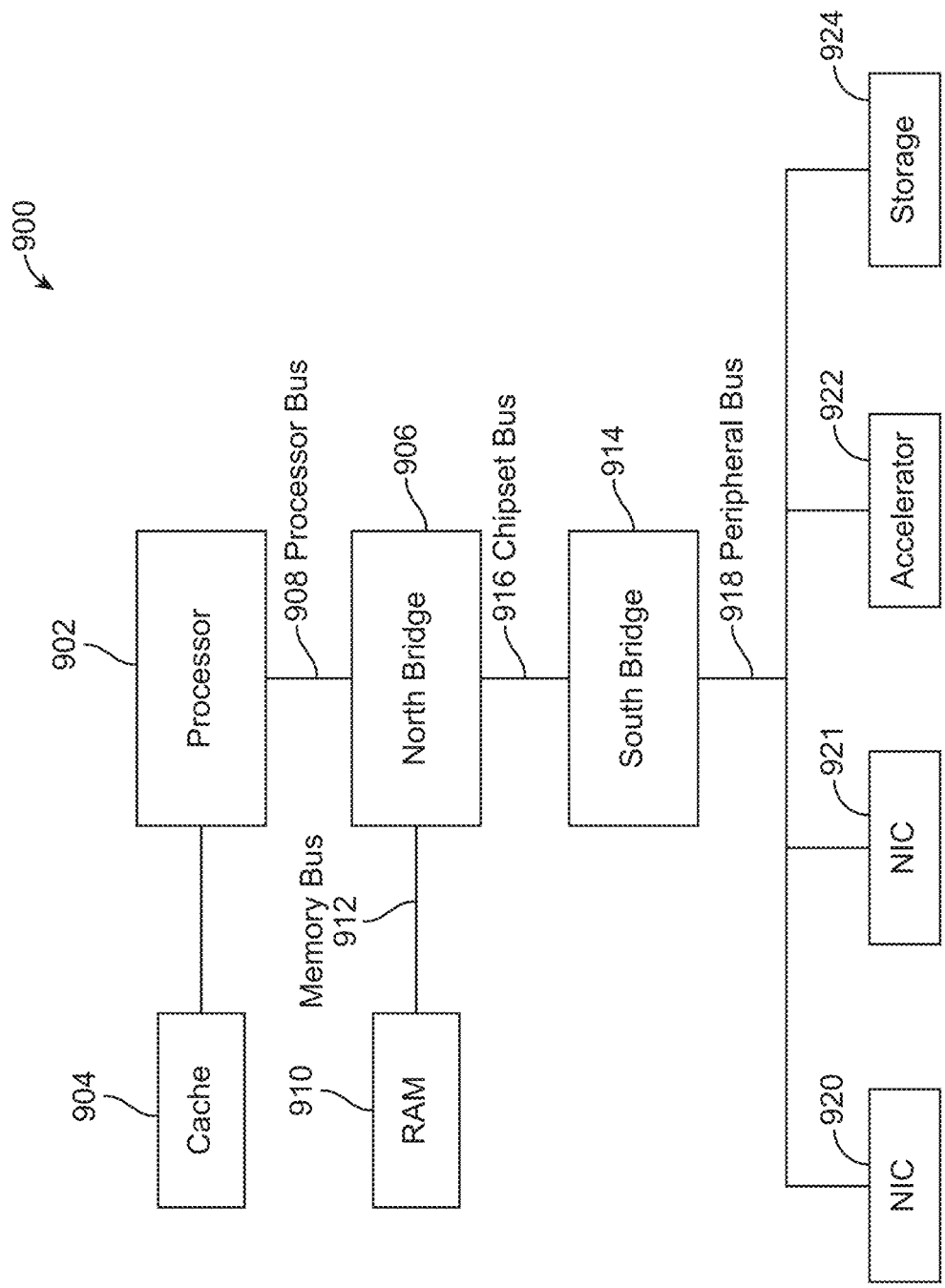
FIG. 9 is a block diagram illustrating an architecture of a computer system.

As illustrated in FIG. 9, a high speed cache 904 can be connected to, or incorporated in, the processor 902 to provide a high speed memory for instructions or data that have been recently, or are frequently, used by processor 902. The processor 902 is connected to a north bridge 906 by a processor bus 908. The north bridge 906 is connected to random access memory (RAM) 910 by a memory bus 912 and manages access to the RAM 910 by the processor 902. The north bridge 906 is also connected to a south bridge 914 by a chipset bus 916. The south bridge 914 is, in turn, connected to a peripheral bus 918. The peripheral bus can be, for example, PCI, PCI-X, PCI Express, or other peripheral bus. The north bridge and south bridge are often referred to as a processor chipset and manage data transfer between the processor, RAM, and peripheral components on the peripheral bus 918. In some alternative architectures, the functionality of the north bridge can be incorporated into the processor instead of using a separate north bridge chip. In some instances, system 900 can include an accelerator card 922 attached to the peripheral bus 918. The accelerator can include field programmable gate arrays (FPGAs) or other hardware for accelerating certain processing. For example, an accelerator can be used for adaptive data restructuring or to evaluate algebraic expressions used in extended set processing.

Software and data are stored in external storage 924 and can be loaded into RAM 910 and/or cache 904 for use by the processor. The system 900 includes an operating system for managing system resources; non-limiting examples of operating systems include: Linux, Windows™, MACOS™, BlackBerry OS™, iOS™, and other functionally-equivalent operating systems, as well as application software running on top of the operating system for managing data storage and optimization in accordance with example instances of the present disclosure. In this example, system 900 also includes network interface cards (NICs) 920 and 921 connected to the peripheral bus for providing network interfaces to external storage, such as Network Attached Storage (NAS) and other computer systems that can be used for distributed parallel processing.

Figure 10:
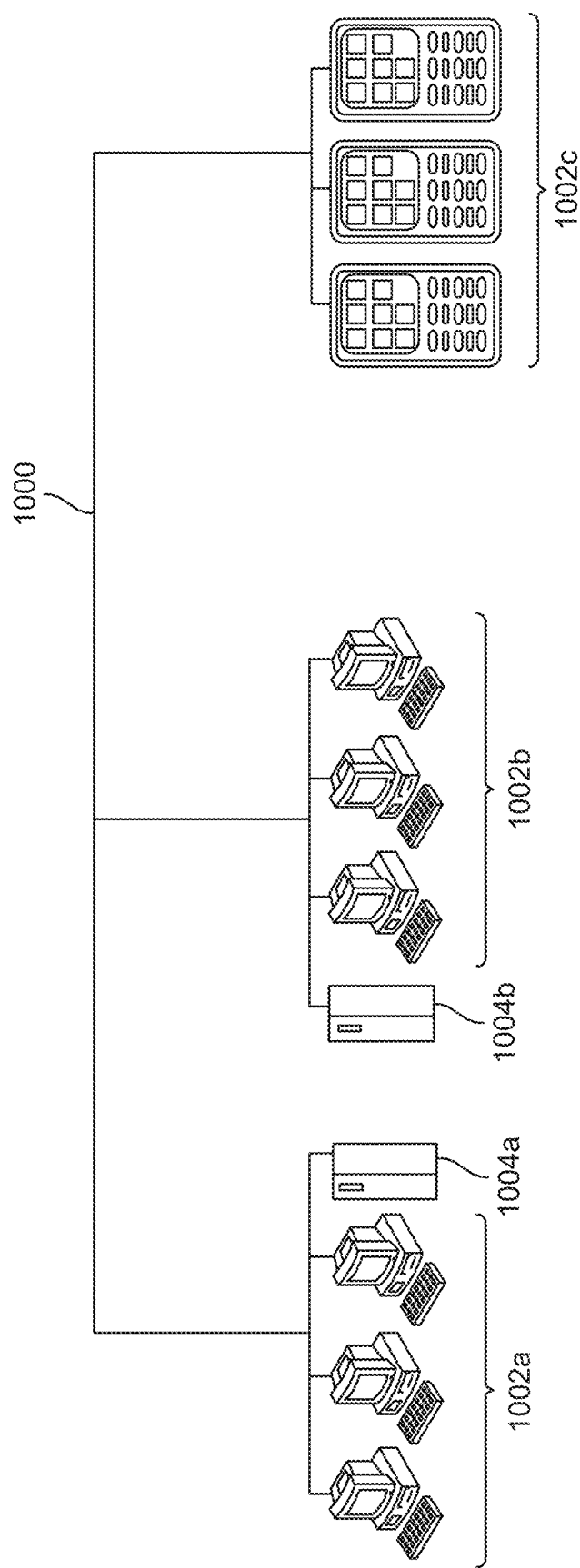
FIG. 10 is a diagram demonstrating a network configured to incorporate a plurality of computer systems, a plurality of cell phones and personal data assistants, and Network Attached Storage (NAS).

FIG. 10 is a diagram showing a network 1000 with a plurality of computer systems 1002a, and 1002b, a plurality of cell phones and personal data assistants 1002c, and Network Attached Storage (NAS) 1004a, and 1004b. In example instances, systems 1002a, 1002b, and 1002c can manage data storage and optimize data access for data stored in Network Attached Storage (NAS) 1004a and 1004b. A mathematical model can be used for the data and be evaluated using distributed parallel processing across computer systems 1002a, and 1002b, and cell phone and personal data assistant systems 1002c. Computer systems 1002a, and 1002b, and cell phone and personal data assistant systems 1002c can also provide parallel processing for adaptive data restructuring of the data stored in Network Attached Storage (NAS) 1004a and 1004b. FIG. 10 illustrates an example only, and a wide variety of other computer architectures and systems can be used in conjunction with the various instances of the present disclosure. For example, a blade server can be used to provide parallel processing. Processor blades can be connected through a back plane to provide parallel processing. Storage can also be connected to the back plane or as Network Attached Storage (NAS) through a separate network interface. In some example instances, processors can maintain separate memory spaces and transmit data through network interfaces, back plane or other connectors for parallel processing by other processors. In other instances, some or all of the processors can use a shared virtual address memory space.

Figure 11:
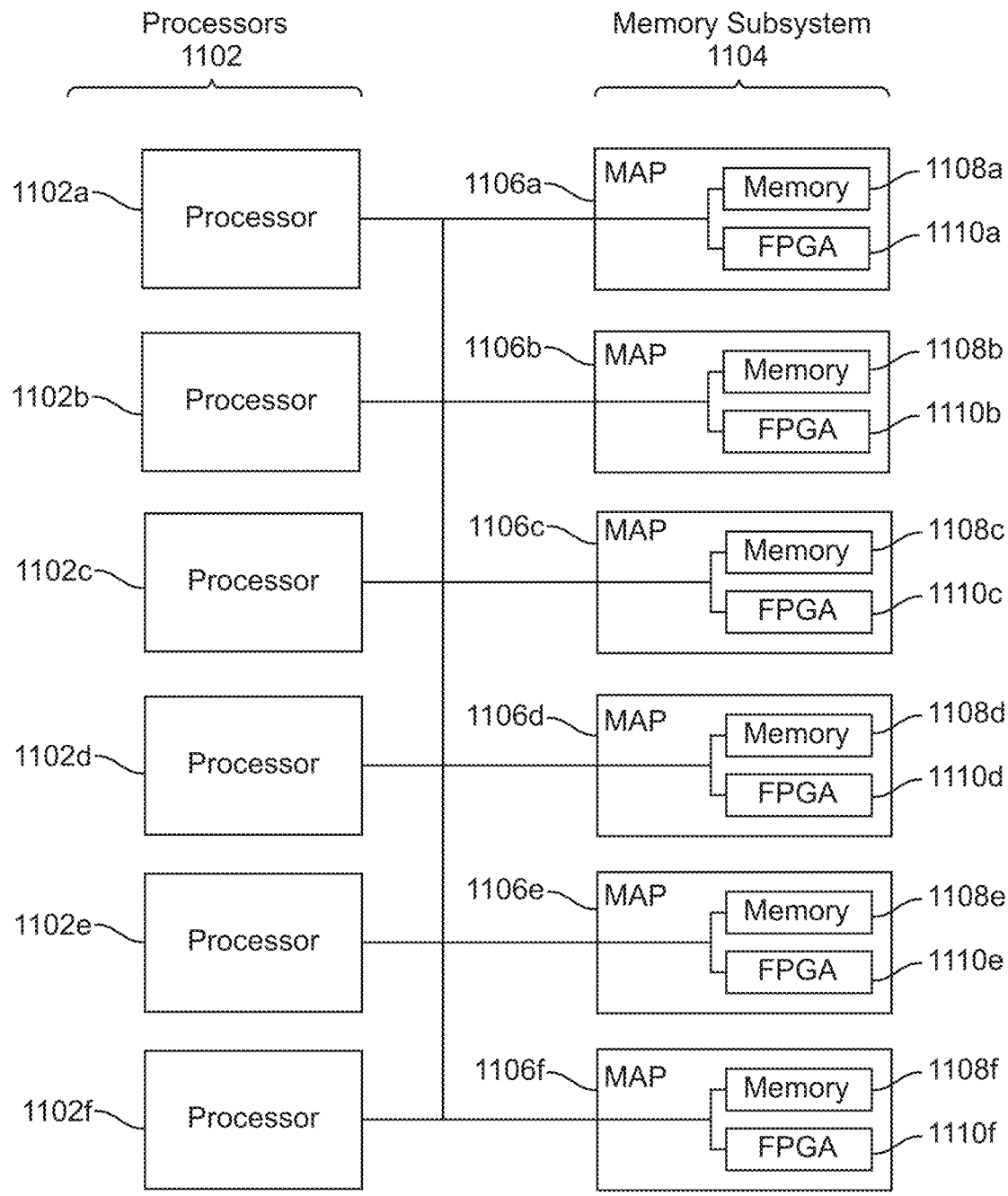
FIG. 11 is a block diagram of a multiprocessor computer system using a shared virtual address memory space.

FIG. 11 is a block diagram of a multiprocessor computer system 1100 using a shared virtual address memory space in accordance with an example instance. The system includes a plurality of processors 1102a-f that can access a shared memory subsystem 1104. The system incorporates a plurality of programmable hardware memory algorithm processors (MAPs) 1106a-f in the memory subsystem 1104. Each MAP 1106a-f can comprise a memory 1108a-f and one or more field programmable gate arrays (FPGAs) 1110a-f. The MAP provides a configurable functional unit and particular algorithms or portions of algorithms can be provided to the FPGAs 1110a-f for processing in close coordination with a respective processor. For example, the MAPs can be used to evaluate algebraic expressions regarding the data model and to perform adaptive data restructuring in example instances. In this example, each MAP is globally accessible by all of the processors for these purposes. In one configuration, each MAP can use Direct Memory Access (DMA) to access an associated memory 1108a-f, allowing it to execute tasks independently of, and asynchronously from the respective microprocessor 1102a-f. In this configuration, a MAP can feed results directly to another MAP for pipelining and parallel execution of algorithms.

The above computer architectures and systems are examples only, and a wide variety of other computer, cell phone, and personal data assistant architectures and systems can be used in connection with example instances, including systems using any combination of general processors, co-processors, FPGAs and other programmable logic devices, system on chips (SOCs), application specific integrated circuits (ASICs), and other processing and logic elements. In some instances, all or part of the computer system can be implemented in software or hardware. Any variety of data storage media can be used in connection with example instances, including random access memory, hard drives, flash memory, tape drives, disk arrays, Network Attached Storage (NAS) and other local or distributed data storage devices and systems.

In example instances, the computer system can be implemented using software modules executing on any of the above or other computer architectures and systems. In other instances, the functions of the system can be implemented partially or completely in firmware, programmable logic devices such as field programmable gate arrays (FPGAs) as referenced in FIG. 9, system on chips (SOCs), application specific integrated circuits (ASICs), or other processing and logic elements. For example, the Set Processor and Optimizer can be implemented with hardware acceleration through the use of a hardware accelerator card, such as accelerator card 922 illustrated in FIG. 9.

The following examples are set forth to illustrate more clearly the principle and practice of embodiments disclosed herein to those skilled in the art and are not to be construed as limiting the scope of any claimed embodiments. Unless otherwise stated, all parts and percentages are on a weight basis.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art.

Example 1: Functionalization of a Device Surface

A device was functionalized to support the attachment and synthesis of a library of polynucleotides. The device surface was first wet cleaned using a piranha solution comprising 90% $H_2SO_4$ and 10% $H_2O_2$ for 20 minutes. The device was rinsed in several beakers with DI water, held under a DI water gooseneck faucet for 5 min, and dried with $N_2$. The device was subsequently soaked in $NH_4OH$ (1:100; 3 mL:300 mL) for 5 min, rinsed with DI water using a handgun, soaked in three successive beakers with DI water for 1 min each, and then rinsed again with DI water using the handgun. The device was then plasma cleaned by exposing the device surface to $O_2$. A SAMCO PC-300 instrument was used to plasma etch $O_2$ at 250 watts for 1 min in downstream mode.

The cleaned device surface was actively functionalized with a solution comprising N-(3-triethoxysilylpropyl)-4-hydroxybutyramide using a YES-1224P vapor deposition oven system with the following parameters: 0.5 to 1 torr, 60 min, 70° C., 135° C. vaporizer. The device surface was resist coated using a Brewer Science 200X spin coater. SPR™ 3612 photoresist was spin coated on the device at 2500 rpm for 40 sec. The device was pre-baked for 30 min at 90° C. on a Brewer hot plate. The device was subjected to photolithography using a Karl Suss MA6 mask aligner instrument. The device was exposed for 2.2 sec and developed for 1 min in MSF 26A. Remaining developer was rinsed with the handgun and the device soaked in water for 5 min. The device was baked for 30 min at 100° C. in the oven, followed by visual inspection for lithography defects using a Nikon L200. A descum process was used to remove residual resist using the SAMCO PC-300 instrument to $O_2$ plasma etch at 250 watts for 1 min.

The device surface was passively functionalized with a 100 µL solution of perfluorooctyltrichlorosilane mixed with 10 µL light mineral oil. The device was placed in a chamber, pumped for 10 min, and then the valve was closed to the pump and left to stand for 10 min. The chamber was vented to air. The device was resist stripped by performing two soaks for 5 min in 500 mL NMP at 70° C. with ultrasonication at maximum power (9 on Crest system). The device was then soaked for 5 min in 500 mL isopropanol at room temperature with ultrasonication at maximum power. The device was dipped in 300 mL of 200 proof ethanol and blown dry with $N_2$. The functionalized surface was activated to serve as a support for polynucleotide synthesis.

Example 2: Synthesis of a 50-Mer Sequence on an Oligonucleotide Synthesis Device A two dimensional oligonucleotide synthesis device was assembled into a flowcell, which was connected to a flowcell (Applied Biosystems (ABI394 DNA Synthesizer"). The two-dimensional oligonucleotide synthesis device was uniformly functionalized with N-(3-TRIETHOXYSILYLPROPYL)-4-HYDROXYBUTYRAMIDE (Gelest) was used to synthesize an exemplary polynucleotide of 50 bp ("50-mer polynucleotide") using polynucleotide synthesis methods described herein.

The sequence of the 50-mer was as described in SEQ ID NO.: 48. 5'AGACAATCAACCATTTGGGGTGGACA GC CTT GACCTCTAGACTTCGGCAT##TTTTTTT TTT3' (SEQ ID NO.: 48), where # denotes Thymidine-succinyl hexamide CED phosphoramidite (CLP-2244 from ChemGenes), which is a cleavable linker enabling the release of oligos from the surface during deprotection.

The synthesis was done using standard DNA synthesis chemistry (coupling, capping, oxidation, and deblocking) according to the protocol in Table 4 and an ABI synthesizer.

TABLE 4

Synthesis protocols

| General DNA Synthesis Process Name | Process Step | Time (sec) |
|---|---|---|
| WASH (Acetonitrile Wash Flow) | Acetonitrile System Flush | 4 |
| | Acetonitrile to Flowcell | 23 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 6 |
| | Activator + Phosphoramidite to Flowcell | 6 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 5 |
| | Activator + Phosphoramidite to Flowcell | 18 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| CAPPING (CapA + B, 1:1, Flow) | CapA + B to Flowcell | 15 |
| WASH (Acetonitrile Wash Flow) | Acetonitrile System Flush | 4 |
| | Acetonitrile to Flowcell | 15 |
| | Acetonitrile System Flush | 4 |
| OXIDATION (Oxidizer Flow) | Oxidizer to Flowcell | 18 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 15 |
| | Acetonitrile System Flush | 4 |
| | Acetonitrile to Flowcell | 15 |
| | N2 System Flush | 4 |
| | Acetonitrile System Flush | 4 |
| | Acetonitrile to Flowcell | 23 |
| | N2 System Flush | 4 |
| | Acetonitrile System Flush | 4 |
| DEBLOCKING (Deblock Flow) | Deblock to Flowcell | 36 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 18 |
| | N2 System Flush | 4.13 |
| | Acetonitrile System Flush | 4.13 |
| | Acetonitrile to Flowcell | 15 |

The phosphoramidite/activator combination was delivered similar to the delivery of bulk reagents through the flowcell. No drying steps were performed as the environment stays "wet" with reagent the entire time.

The flow restrictor was removed from the ABI 394 synthesizer to enable faster flow. Without flow restrictor, flow rates for amidites (0.1M in ACN), Activator, (0.25M Benzoylthiotetrazole ("BTT"; 30-3070-xx from GlenResearch) in ACN), and Ox (0.02M 12 in 20% pyridine, 10% water, and 70% THF) were roughly ~100 uL/sec, for acetonitrile ("ACN") and capping reagents (1:1 mix of CapA and CapB, wherein CapA is acetic anhydride in THF/Pyridine and CapB is 16% 1-methylimidizole in THF), roughly ~200 uL/sec, and for Deblock (3% dichloroacetic acid in toluene), roughly ~300 uL/sec (compared to ~50 uL/sec for all reagents with flow restrictor). The time to completely push out Oxidizer was observed, the timing for chemical flow times was adjusted accordingly and an extra ACN wash was introduced between different chemicals. After polynucleotide synthesis, the chip was deprotected in gaseous ammonia overnight at 75 psi. Five drops of water were applied to the surface to recover polynucleotides. The recovered polynucleotides were then analyzed on a BioAnalyzer small RNA chip.

Example 3: Synthesis of a 100-Mer Sequence on an Oligonucleotide Synthesis Device The same process as described in Example 2 for the synthesis of the 50-mer sequence was used for the synthesis of a 100-mer polynucleotide ("100-mer polynucleotide"; 5' CGGGATCCTTATCGTCATCGTCGTACAGATCCCGAC CCATTTGCTGTCCACCAGTCATG CTAGCCATACCAT GATGATGATGATGATGAGAACCCCGCAT##TTTTTT TTTT3', where # denotes Thymidine-succinyl hexamide CED phosphoramidite (CLP-2244 from ChemGenes); SEQ ID NO.: 49) on two different silicon chips, the first one uniformly functionalized with N-(3-TRIETHOXYSILYL-PROPYL)-4-HYDROXYBUTYRAMIDE and the second one functionalized with 5/95 mix of 11-acetoxyundecyltriethoxysilane and n-decyltriethoxysilane, and the polynucleotides extracted from the surface were analyzed on a BioAnalyzer instrument.

All ten samples from the two chips were further PCR amplified using a forward (5'ATGCGGGGTTCTCAT-CATC3; SEQ ID NO.: 50) and a reverse (5'CGGGATCCT-TATCGTCATCG3; SEQ ID NO.: 51) primer in a 50 uL PCR mix (25 uL NEB Q5 mastermix, 2.5 uL 10 uM Forward primer, 2.5 uL 10 uM Reverse primer, luL polynucleotide extracted from the surface, and water up to 50 uL) using the following thermalcycling program:

98° C., 30 sec

98° C., 10 sec; 63° C., 10 sec; 72° C., 10 sec; repeat 12 cycles

72° C., 2 min

The PCR products were also run on a BioAnalyzer, demonstrating sharp peaks at the 100-mer position. Next, the PCR amplified samples were cloned, and Sanger sequenced. Table 5 summarizes the results from the Sanger sequencing for samples taken from spots 1-5 from chip 1 and for samples taken from spots 6-10 from chip 2.

TABLE 5

Sequencing results

| Spot | Error rate | Cycle efficiency |
|---|---|---|
| 1 | 1/763 bp | 99.87% |
| 2 | 1/824 bp | 99.88% |
| 3 | 1/780 bp | 99.87% |
| 4 | 1/429 bp | 99.77% |
| 5 | 1/1525 bp | 99.93% |
| 6 | 1/1615 bp | 99.94% |
| 7 | 1/531 bp | 99.81% |
| 8 | 1/1769 bp | 99.94% |
| 9 | 1/854 bp | 99.88% |
| 10 | 1/1451 bp | 99.93% |

Thus, the high quality and uniformity of the synthesized polynucleotides were repeated on two chips with different surface chemistries. Overall, 89% of the 100-mers that were sequenced were perfect sequences with no errors, corresponding to 233 out of 262.

Table 6 summarizes error characteristics for the sequences obtained from the polynucleotides samples from spots 1-10.

TABLE 6

Error characteristics

| | Sample ID/Spot no. | | | | |
|---|---|---|---|---|---|
| | OSA_0046/1 | OSA_0047/2 | OSA_0048/3 | OSA_0049/4 | OSA_0050/5 |
| Total Sequences | 32 | 32 | 32 | 32 | 32 |
| Sequencing Quality | 25 of 28 | 27 of 27 | 26 of 30 | 21 of 23 | 25 of 26 |
| Oligo Quality | 23 of 25 | 25 of 27 | 22 of 26 | 18 of 21 | 24 of 25 |
| ROI Match Count | 2500 | 2698 | 2561 | 2122 | 2499 |
| ROI Mutation | 2 | 2 | 1 | 3 | 1 |
| ROI Multi Base Deletion | 0 | 0 | 0 | 0 | 0 |
| ROI Small Insertion | 1 | 0 | 0 | 0 | 0 |
| ROI Single Base Deletion | 0 | 0 | 0 | 0 | 0 |
| Large Deletion Count | 0 | 0 | 1 | 0 | 0 |
| Mutation: G > A | 2 | 2 | 1 | 2 | 1 |
| Mutation: T > C | 0 | 0 | 0 | 1 | 0 |
| ROI Error Count | 3 | 2 | 2 | 3 | 1 |
| ROI Error Rate | Err: ~1 in 834 | Err: ~1 in 1350 | Err: ~1 in 1282 | Err: ~1 in 708 | Err: ~1 in 2500 |
| ROI Minus Primer Error Rate | MP Err: ~1 in 763 | MP Err: ~1 in 824 | MP Err: ~1 in 780 | MP Err: ~1 in 429 | MP Err: ~1 in 1525 |

TABLE 6-continued

Error characteristics

| | Sample ID/Spot no. | | | | |
|---|---|---|---|---|---|
| | OSA_0051/6 | OSA_0052/7 | OSA_0053/8 | OSA_0054/9 | OSA_0055/10 |
| Total Sequences | 32 | 32 | 32 | 32 | 32 |
| Sequencing Quality | 29 of 30 | 27 of 31 | 29 of 31 | 28 of 29 | 25 of 28 |
| Oligo Quality | 25 of 29 | 22 of 27 | 28 of 29 | 26 of 28 | 20 of 25 |
| ROI Match Count | 2666 | 2625 | 2899 | 2798 | 2348 |
| ROI Mutation | 0 | 2 | 1 | 2 | 1 |
| ROI Multi Base Deletion | 0 | 0 | 0 | 0 | 0 |
| ROI Small Insertion | 0 | 0 | 0 | 0 | 0 |
| ROI Single Base Deletion | 0 | 0 | 0 | 0 | 0 |
| Large Deletion Count | 1 | 1 | 0 | 0 | 0 |
| Mutation: G > A | 0 | 2 | 1 | 2 | 1 |
| Mutation: T > C | 0 | 0 | 0 | 0 | 0 |
| ROI Error Count | 1 | 3 | 1 | 2 | 1 |
| ROI Error Rate | Err: ~1 in 2667 | Err: ~1 in 876 | Err: ~1 in 2900 | Err: ~1 in 1400 | Err: ~1 in 2349 |
| ROI Minus Primer | MP | MP | MP | MP | MP |
| Error Rate | Err: ~1 in 1615 | Err: ~1 in 531 | Err: ~1 1769 | Err: ~1 in 854 | Err: ~1 1451 |

Example 4: Design of G Protein-Coupled Receptor Binding Domains Based on Conformational Ligand Interactions G protein-coupled receptor (GPCR) binding domains were designed using interaction surfaces between conformational ligands that interact with GPCRs. Analysis of the interaction surfaces between chemokines and cytokines and the GPCRs indicated that the N-terminal peptide prior to the first conformational cysteine represents the activation peptide, and the core helical and beta-turn-beta topologies mediate interactions with the extracellular domain (ECD) of the GPCR.

An additional 254 GPCR ligands were designed based on cross-searching Uniprot and IUPHAR databases. The ligands represented 112 human, 71 rat, 4 pig, 1 sheep, and 1 cow derived interaction classes. The ligands were then collapsed to the following 101 cross-species ligand sequence annotations: ADM, ADM2, Agouti-related protein, Angiotensinogen, Annexin A1, Apelin, Apelin receptor early, Appetite regulating hormone, Beta-defensin 4A, C—C motif chemokine, C—X—C motif chemokine, Calcitonin, Calcitonin gene-related peptide, Cathepsin G, Cathepsin G (Fragment), Cholecystokinin, Complement C3, Complement C5, Complement C5 (Fragment), Corticoliberin, Cortistatin, Cytokine SCM-1 beta, Endothelin-2, Endothelin-3, Eotaxin, Fractalkine, Galanin peptides, Galanin-like peptide, Gastric inhibitory polypeptide, Gastrin, Gastrin-releasing peptide, Glucagon, Growth-regulated alpha protein, Heme-binding protein 1, Humanin, Insulin-like 3, Insulin-like peptide INSL5, Interleukin-8, Islet amyloid polypeptide, Kininogen-1, Lymphotactin, Metastasis-suppressor KiSS-1, Neurokinin-B, Neuromedin-B, Neuromedin-S, Neuromedin-U, Neuropeptide B, Neuropeptide S, Neuropeptide W, Neurotensin/neuromedin N, Orexigenic neuropeptide QRFP, Orexin, Oxytocin-neurophysin 1, Pancreatic prohormone, Parathyroid hormone, Parathyroid hormone-related protein, Peptide YY, Pituitary adenylate cyclase-activating, Platelet basic protein, Platelet factor 4, Prepronociceptin, Pro-FMRFamide-related neuropeptide FF, Pro-FMRFamide-related neuropeptide VF, Pro-MCH, Pro-neuropeptide Y, Pro-opiomelanocortin, Pro-thyrotropin releasing hormone, Proenkephalin-A, Proenkephalin-B, Progonadoliberin-1, Progonadoliberin-2, Prokineticin-1, Prokineticin-2, Prolactin-releasing peptide, Promotilin, Protachykinin-1, Protein Wnt-2, Protein Wnt-3a, Protein Wnt-4, Protein Wnt-5a, Protein Wnt-7b, Prothrombin, Proto-oncogene Wnt-1, Protooncogene Wnt-3, Putative uncharacterized protein, RCG55748, Retinoic acid receptor, Secretin, Somatoliberin, Somatostatin, Stromal cell-derived factor, T-kininogen 2, Tuberoinfundibular peptide of, Urocortin, Urocortin-2, Urocortin-3, Urotensin-2, Urotensin-2B, VEGF coregulated chemokine, VIP peptides, and Vasopressin-neurophysin 2-copeptin.

Structural analysis of the ligands was performed and indicated that a majority of them comprised the N-terminal activation peptide of about 11 amino acids. Motif variants were then created by trimming back the N-terminal activation peptide. As seen in Table 7, an exemplary set of variants were created based on the N-terminal activation peptide for stromal derived factor-1. The motif variants were also placed combinatorially at multiple positions in the CDR-H3. A total of 1016 motifs were extracted for placement in the CDR-H3. In addition, the motif variants were provided with variably boundary placement and with 5-20 substring variants that were also placed in the CDR-H3.

TABLE 7

| Variant amino acid sequences for stromal derived factor-1 | | |
|---|---|---|
| SEQ ID NO. | Variant | Amino Acid Sequence |
| 53 | 1 | ggggSDYKPVSLSYR |
| 54 | 2 | ggggDYKPVSLSYR |
| 55 | 3 | ggggYKPVSLSYR |
| 56 | 4 | ggggKPVSLSYR |
| 57 | 5 | ggggPVSLSYR |

As seen in Table 8, an exemplary set of variants were created for interleukin-8 based on the following sequence:

(SEQ ID NO: 52)
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS.

TABLE 8

Variant amino acid sequences for inteleukin-8

| SEQ ID NO. | Variant | Amino Acid Sequence |
|---|---|---|
| 58 | 1 | ggggSAALCEGAVLPRSA |
| 59 | 2 | ggggAALCEGAVLPRSA |
| 60 | 3 | ggggALCEGAVLPRSA |
| 61 | 4 | ggggLCEGAVLPRSA |
| 62 | 5 | ggggCEGAVLPRSA |
| 63 | 6 | ggggSAALCEGAVLPRSAKE |
| 64 | 7 | ggggAALCEGAVLPRSAKE |
| 65 | 8 | ggggALCEGAVLPRSAKE |
| 66 | 9 | ggggLCEGAVLPRSAKE |
| 67 | 10 | ggggCEGAVLPRSAKE |
| 68 | 11 | ggggSAALCEGAVLPRSAKELR |
| 69 | 12 | ggggAALCEGAVLPRSAKELR |
| 70 | 13 | ggggALCEGAVLPRSAKELR |
| 71 | 14 | ggggLCEGAVLPRSAKELR |
| 72 | 15 | ggggCEGAVLPRSAKELR |

Bradykinin, Caerulein, Calcitonin, Calcitonin Gene Related Peptide, CGRP, Cholecystokinin, Endothelin, Endothelin 1, Endothelin 2, Endothelin 3, GIP, GIPs, GLP, Galanin, Gastrin, Ghrelin, Glucagon, IAPP, Kisspeptin, Mca, Metasti, Neuromedin, Neuromedin N, Neuropeptide, Neuropeptide F, Neuropeptide Y, Neurotensin, Nociceptin, Orexin, Orexin A, Orphanin, Oxytocin, Oxytocin Galanin, PACAP, PACAPs, PAR (Protease Activated Receptor) Peptides, PAR-1 Agonist, Pramlintide, Scyliorhinin I, Secretin, Senktide, Somatostatin, Somatostatin 14, Somatostatin 28, Substance P, Urotensin II, VIP, VIPs, Vasopressin, Xenin, cinnamoyl, furoyl, gastrin, holecystokinin, α-Mating Factor Pheromone. It was observed that the peptides formed a stabilized interaction with the GPCR extracellular domain (ECD).

Motif variants were generated based on the interaction surface of the peptides with the ECD as well as with the N-terminal GPCR ligand interaction surface. This was done using structural modeling. Exemplary motif variants were created based on glucagon like peptide's interaction with its GPCR as seen in Table 9. The motif variant sequences were generated using the following sequence from glucagon like peptide:

(SEQ ID NO: 73)
HAEGTFTSDVSSYLEGQAAKEFIAWLVKGRG.

TABLE 9

Variant amino acid sequences for glucagon like peptide

| SEQ ID NO. | Variant | Amino Acid Sequence |
|---|---|---|
| 74 | 1 | sggggsggggsggggHAEGTFTSDVSSYLEGQAAKEFIAWLV |
| 75 | 2 | sggggsggggsggggAEGTFTSDVSSYLEGQAAKEFIAWLV |
| 76 | 3 | sggggsggggsggggEGTFTSDVSSYLEGQAAKEFIAWLV |
| 77 | 4 | sggggsggggsggggGTFTSDVSSYLEGQAAKEFIAWLV |
| 78 | 5 | sggggsggggsggggTFTSDVSSYLEGQAAKEFIAWLV |
| 79 | 6 | sggggsggggsggggFTSDVSSYLEGQAAKEFIAWLV |
| 80 | 7 | sggggsggggsggggTSDVSSYLEGQAAKEFIAWLV |
| 81 | 8 | sggggsggggsggggSDVSSYLEGQAAKEFIAWLV |
| 82 | 9 | sggggsggggsggggDVSSYLEGQAAKEFIAWLV |

Example 5: Design of G Protein-Coupled Receptor Binding Domains Based on Peptide Ligand Interactions GPCR binding domains were designed based on interaction surfaces between peptide ligands that interact with class B GPCRs. About 66 different ligands were used and include the following ligand sequence annotations: Adrenomedullin, Amylin, Angiotensin, Angiotensin I, Angiotensin II, Angiotensin III, Apelin, Apstatin, Big Endothelin, Big Gastrin, Example 6: Design of G Protein-Coupled Receptor Binding Domains Based on Small Molecule Interactions GPCR binding domains were designed based on interaction surfaces between small molecule ligands that interact with GPCRs. By analyzing multiple GPCR ligands, an amino acid library of Tyr, Pro, Phe, His, and Gly was designed as being able to recapitulate many of the structural contacts of these ligands. An exemplary motif variant that was generated based on these observations comprises the following sequence:

sgggg(F,G,H,P,Y)(F,G,H,P,Y)(F,G,H,P,Y)(F,G,H,P,Y) (SEQ ID NO: 83)
(F,G,H,P,Y)(F,G,H,P,Y)(F,G,H,P,Y)(F,G,H,P,Y).

Example 7: Design of G Protein-Coupled Binding Domains Based on Extracellular Domain Interactions GPCR binding domains were designed based on interaction surfaces on extracellular domains (ECDs) and extracellular loops (ECLs) of GPCRs. About 2,257 GPCRs from human (356), mouse (369), rat (259), cow (102), pig (60), primate, fish, fly, and over 200 other organisms were analyzed, and it was observed that ECDs provide multiple complementary contacts to other loops and helices of the GPCR at a length of 15 amino acids. Further analysis of the ECLs from the about 2,257 GPCRs and all solved structures of GPCRs demonstrated that the N-terminal ECD1 and ECL2 comprise longer extracellular sequences and provide GPCR extracellular contacts.

Motif variants were then generated based on these sequences. Exemplary variants based on the following sequence from retinoic acid induced protein 3 (GPRC5A) were generated:

EYIVLTMNRTNVNVFSELSAPRRNED. (SEQ ID NO: 84)

See Table 10.

TABLE 10

| Amino acid sequences | | |
|---|---|---|
| SEQ ID NO. | Variant | Amino Acid Sequence |
| 85 | 1 | YIVLTMNRTNVNVFSELSAPRRNE |
| 86 | 2 | IVLTMNRTNVNVFSELSAPRRN |
| 87 | 3 | VLTMNRTNVNVFSELSAPRR |

Example 8: Design of Antibody Scaffolds

To generate scaffolds, structural analysis, repertoire sequencing analysis of the heavy chain, and specific analysis of heterodimer high-throughput sequencing datasets were performed. Each heavy chain was associated with each light chain scaffold. Each heavy chain scaffold was assigned 5 different long CDR-H3 loop options. Each light chain scaffold was assigned 5 different L3 scaffolds. The heavy chain CDR-H3 stems were chosen from the frequently observed long H3 loop stems (10 amino acids on the N-terminus and the C-terminus) found both across individuals and across V-gene segments. The light chain scaffold L3s were chosen from heterodimers comprising long H3s. Direct heterodimers based on information from the Protein Data Bank (PDB) and deep sequencing datasets were used in which CDR H1, H2, L1, L2, L3, and CDR-H3 stems were fixed. The various scaffolds were then formatted for display on phage to assess for expression.

Structural Analysis

About 2,017 antibody structures were analyzed from which 22 structures with long CDR-H3s of at least 25 amino acids in length were observed. The heavy chains included the following: IGHV1-69, IGHV3-30, IGHV4-49, and IGHV3-21. The light chains identified included the following: IGLV3-21, IGKV3-11, IGKV2-28, IGKV1-5, IGLV1-51, IGLV1-44, and IGKV1-13. In the analysis, four heterodimer combinations were observed multiple times including: IGHV4-59/61-IGLV3-21, IGHV3-21-IGKV2-28, IGHV1-69-IGKV3-11, and IGHV1-69-IGKV1-5. An analysis of sequences and structures identified intra-CDR-H3 disulfide bonds in a few structures with packing of bulky side chains such as tyrosine in the stem providing support for long H3 stability. Secondary structures including beta-turn-beta sheets and a "hammerhead" subdomain were also observed.

Repertoire Analysis

A repertoire analysis was performed on 1,083,875 IgM+/CD27-naïve B cell receptor (BCR) sequences and 1,433,011 CD27+ sequences obtained by unbiased 5'RACE from 12 healthy controls. The 12 healthy controls comprised equal numbers of male and female and were made up of 4 Caucasian, 4 Asian, and 4 Hispanic individuals. The repertoire analysis demonstrated that less than 1% of the human repertoire comprises BCRs with CDR-H3s longer than 21 amino acids. A V-gene bias was observed in the long CDR3 subrepertoire, with IGHV1-69, IGHV4-34, IGHV1-18, and IGHV1-8 showing preferential enrichment in BCRs with long H3 loops. A bias against long loops was observed for IGHV3-23, IGHV4-59/61, IGHV5-51, IGHV3-48, IGHV3-53/66, IGHV3-15, IGHV3-74, IGHV3-73, IGHV3-72, and IGHV2-70. The IGHV4-34 scaffold was demonstrated to be autoreactive and had a short half-life.

Viable N-terminal and C-terminal CDR-H3 scaffold variation for long loops were also designed based on the 5'RACE reference repertoire. About 81,065 CDR-H3s of amino acid length 22 amino acids or greater were observed. By comparing across V-gene scaffolds, scaffold-specific H3 stem variation was avoided as to allow the scaffold diversity to be cloned into multiple scaffold references.

Heterodimer Analysis

Heterodimer analysis was performed on scaffolds having sequences as seen in FIGS. 12A-12C. Variant sequences and lengths of the scaffolds were assayed.

Structural Analysis

Structural analysis was performed using GPCR scaffolds of variant sequences and lengths were assayed. See FIG. 13.

Example 9: Generation of GPCR Antibody Libraries

Figure 5:
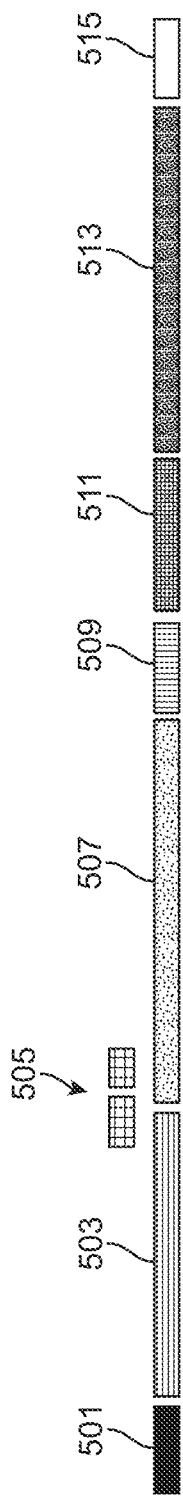
FIG. 5 depicts schematics of segments for assembly of clonal fragments and non-clonal fragments.
Figure 6:
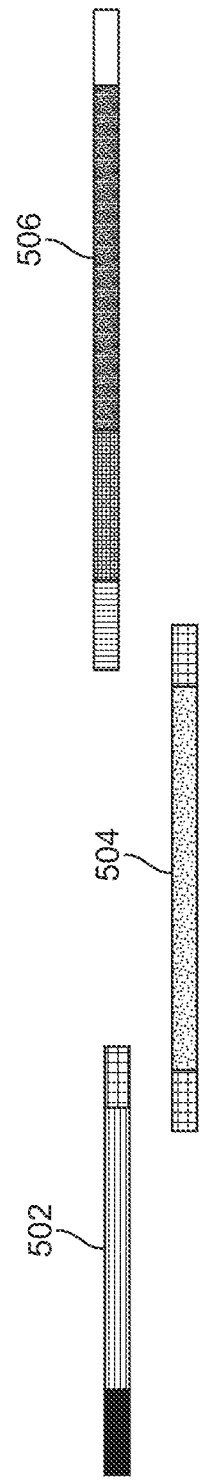
FIG. 6 depicts schematics of segments for assembly of clonal fragments and non-clonal fragments.

Based on GPCR-ligand interaction surfaces and scaffold arrangements, libraries were designed and de novo synthesized. See Examples 4-8. Referring to FIG. 5, 10 variant sequences were designed for the variable domain, heavy chain 503, 237 variant sequences were designed for the heavy chain complementarity determining region 3 507, and 44 variant sequences were designed for the variable domain, light chain 513. The fragments were synthesized as three fragments as seen in FIG. 6 following similar methods as described in Examples 1-3.

Figure 15:
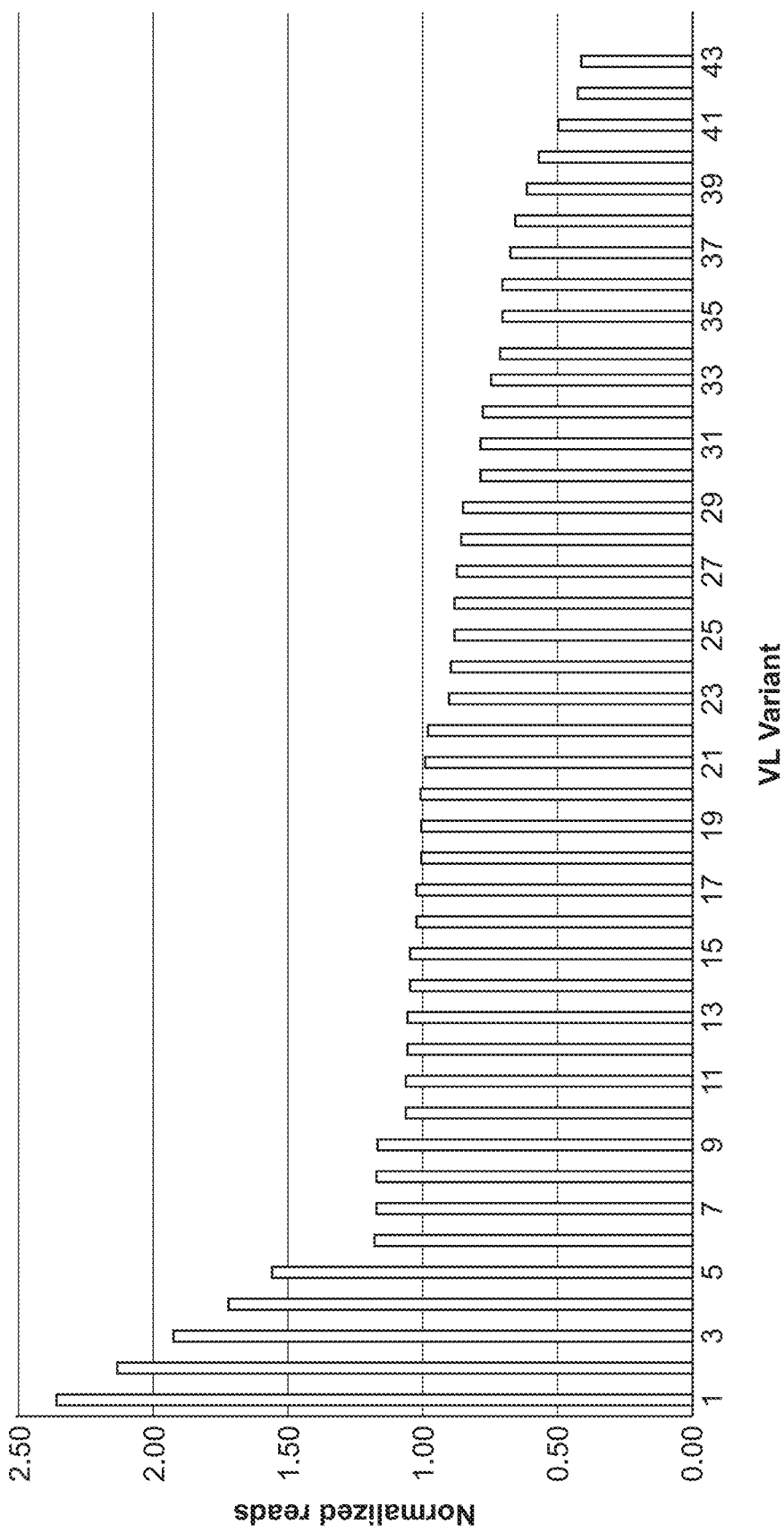
FIG. 15 is a graph of normalized reads for a library for variable domain, light chains.
Figure 16:
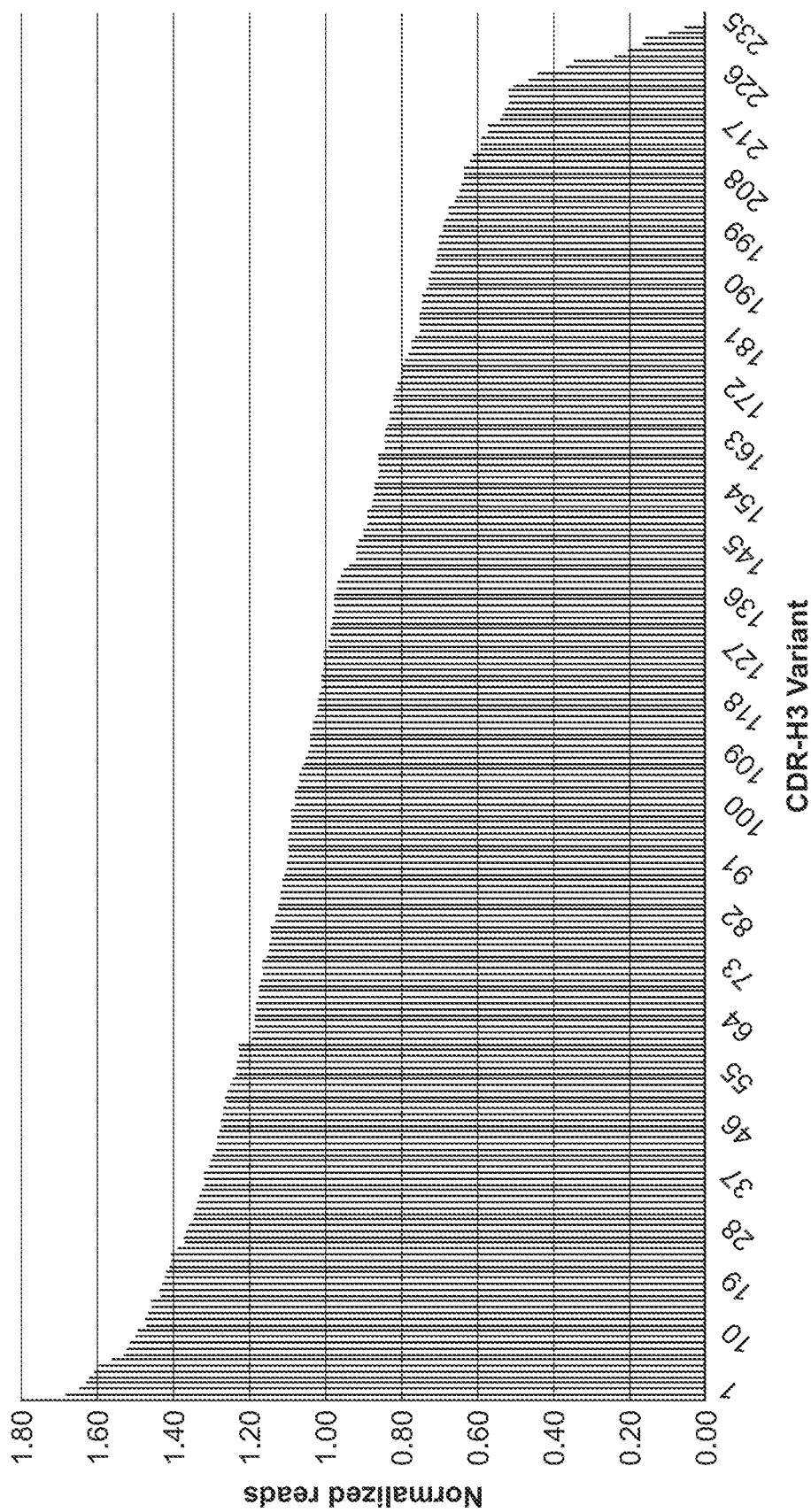
FIG. 16 is a graph of normalized reads for a library for heavy chain complementarity determining region 3.
Figure 17A:
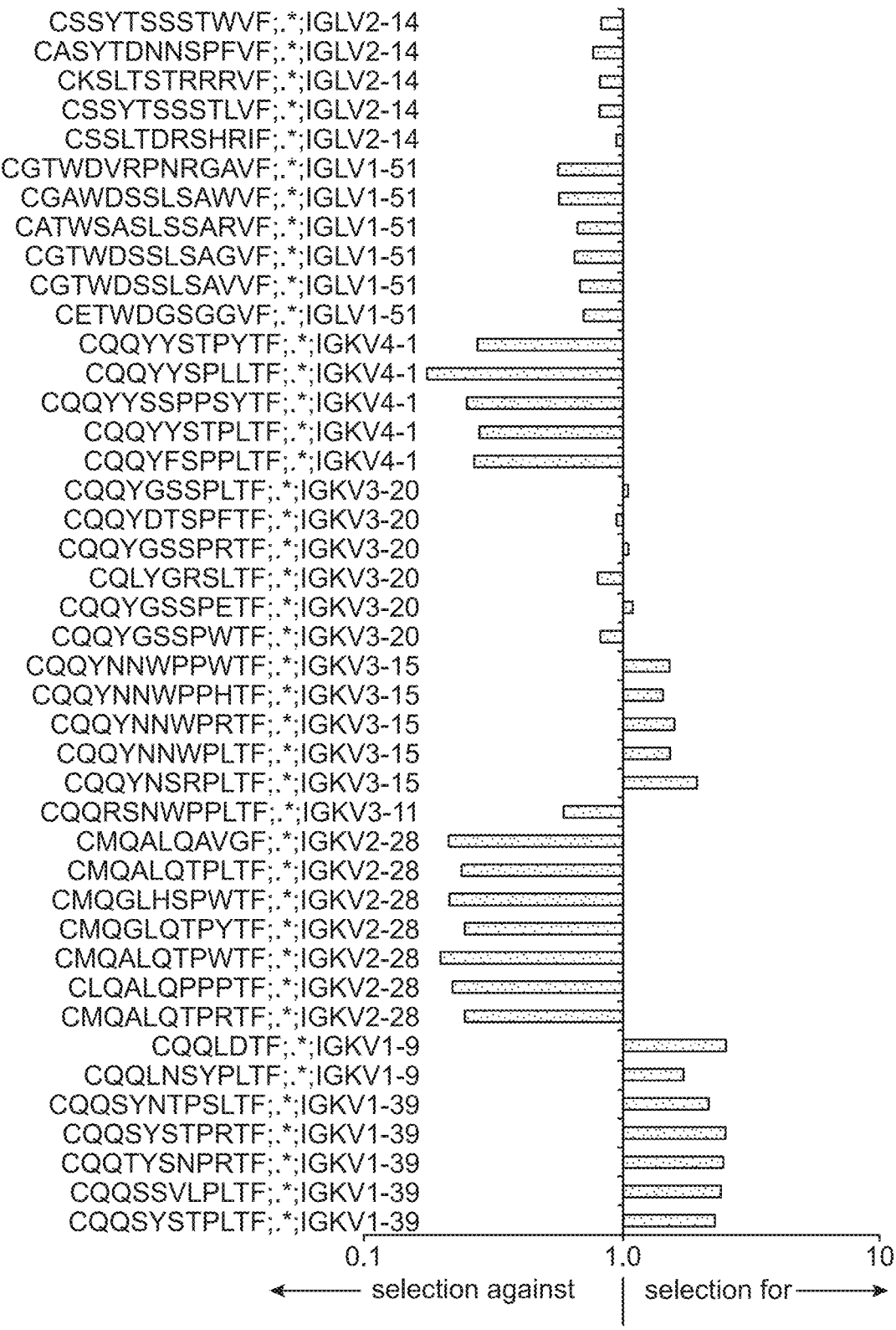
FIG. 17A is a plot of light chain frameworks assayed for folding.
Figure 17B:
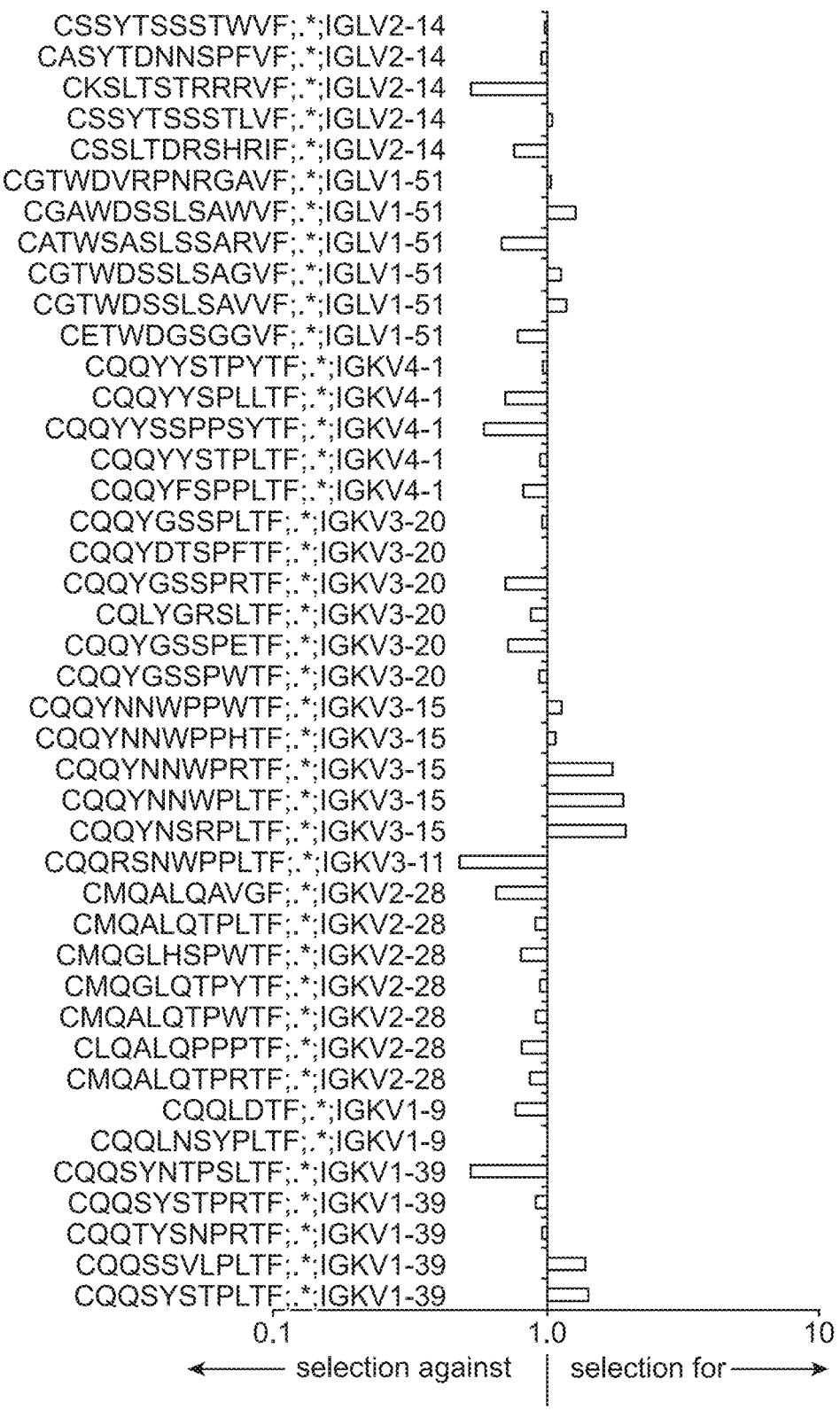
FIG. 17B is a plot of light chain frameworks assayed for thermostability.
Figure 17C:
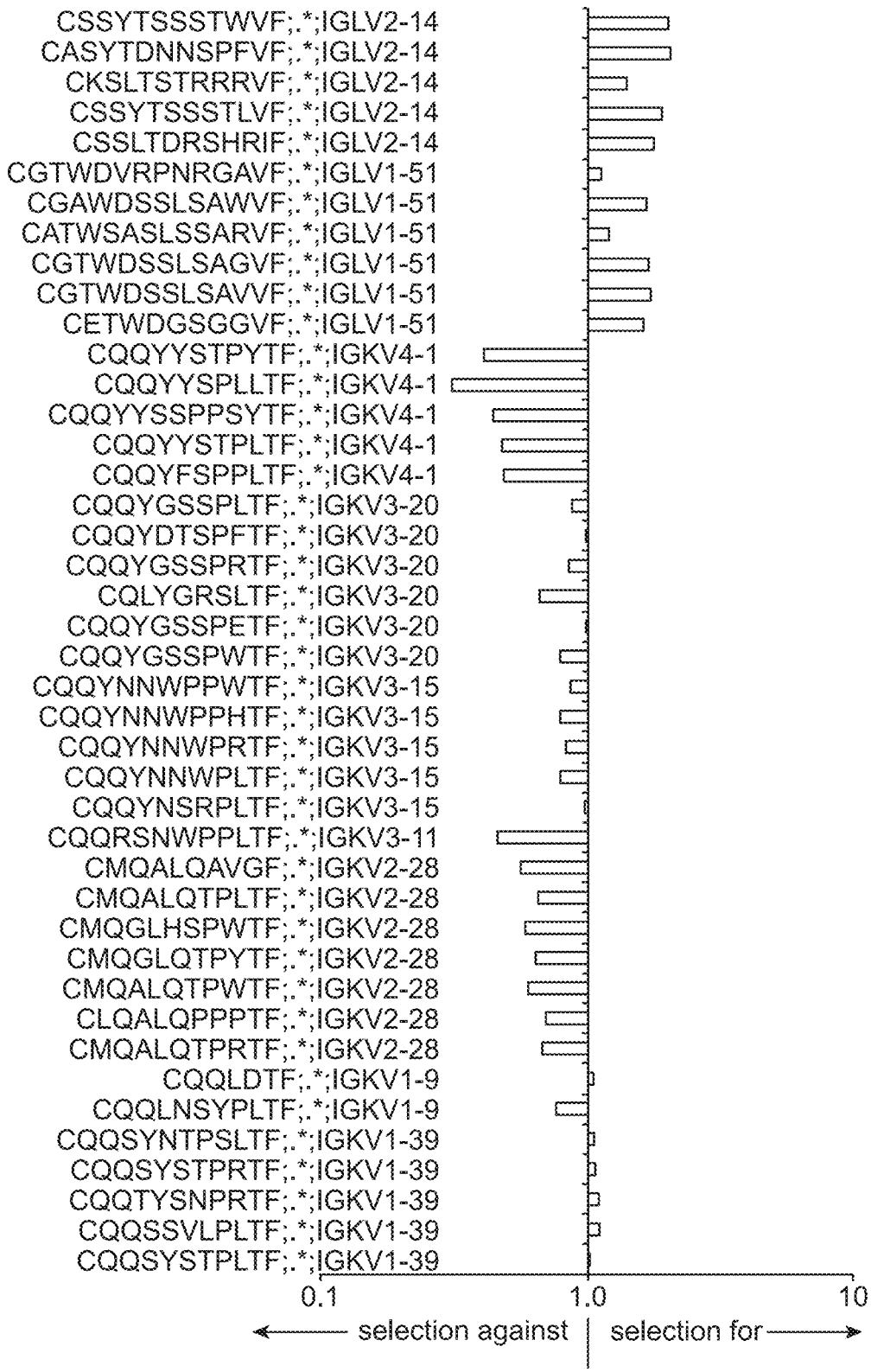
FIG. 17C is a plot of light chain frameworks assayed for motif display using FLAG tag.
Figure 17D:
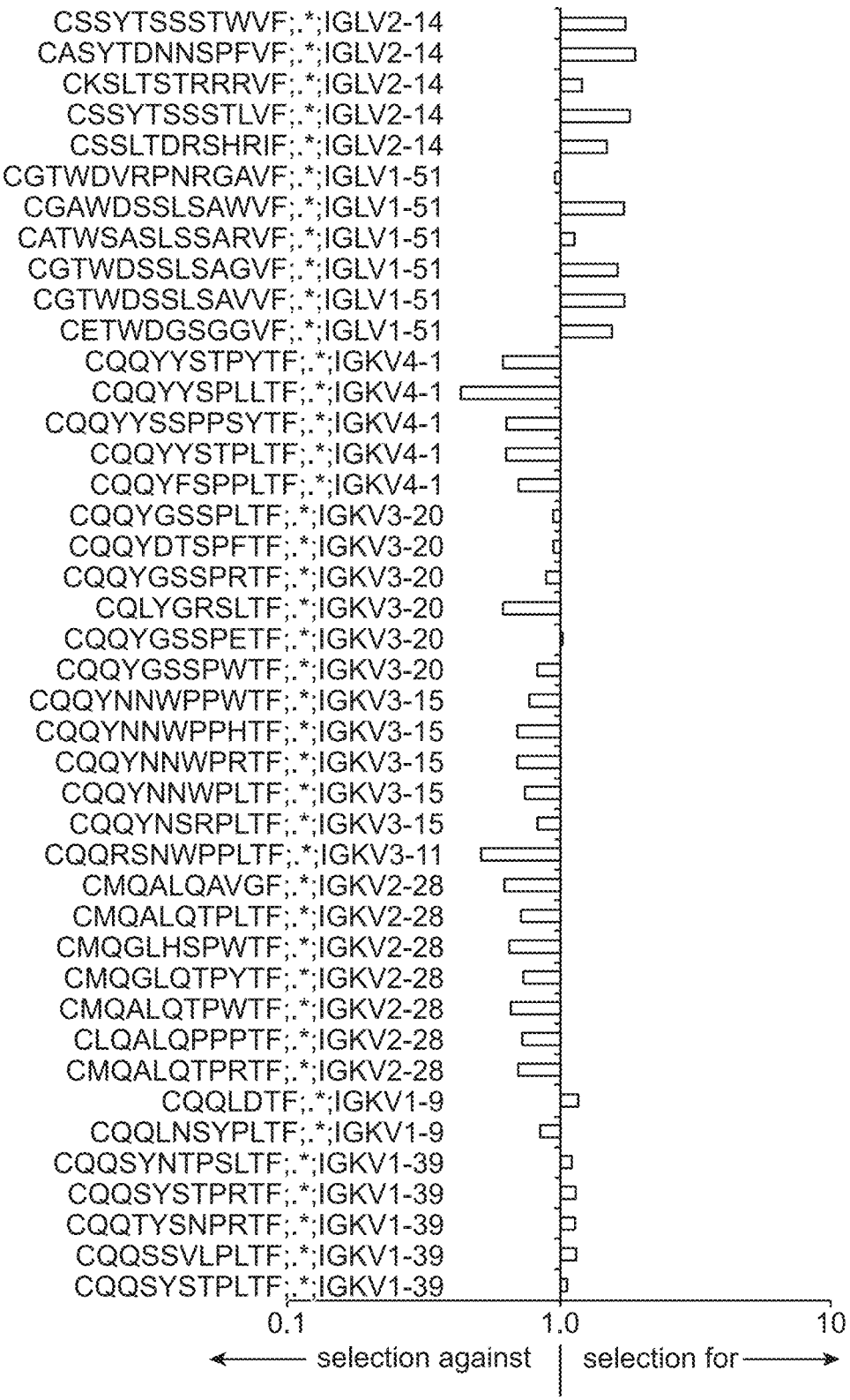
FIG. 17D is a plot of light chain frameworks assayed for motif display using His tag.
Figures 18C, 18D:
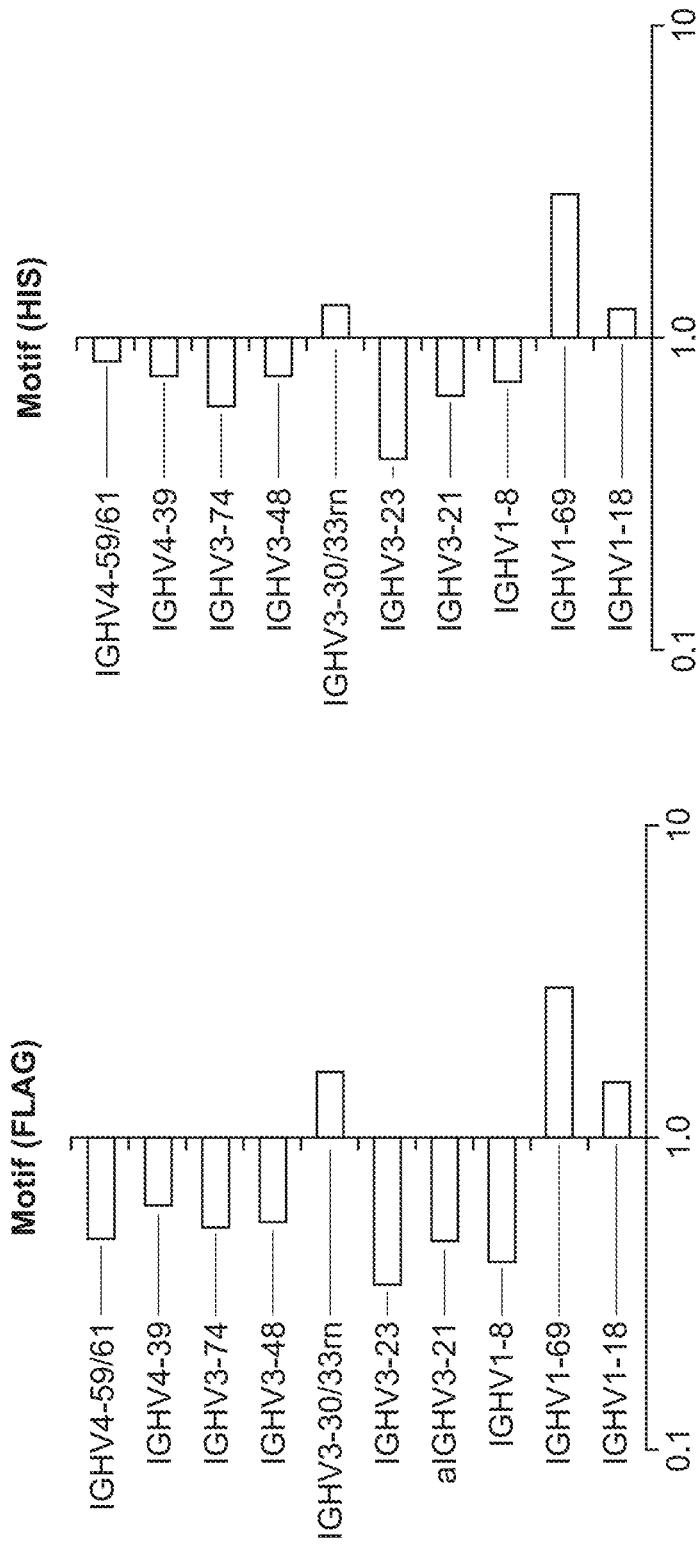
FIG. 18C is a plot of heavy chain frameworks assayed for motif display using FLAG tag.
FIG. 18D is a plot of heavy chain frameworks assayed for motif display using His tag.
Figure 18F:
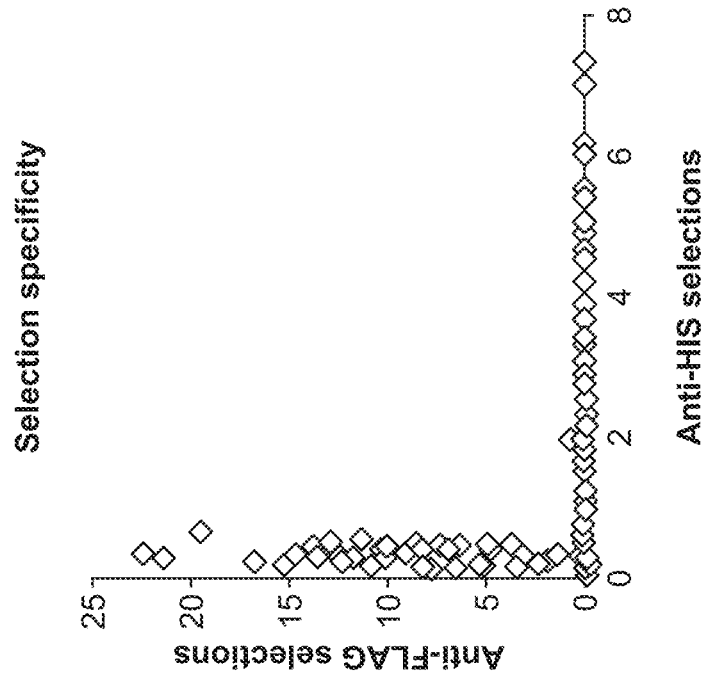
FIG. 18F is a plot of heavy chain frameworks assayed for selection specificity.
Figure 18E:
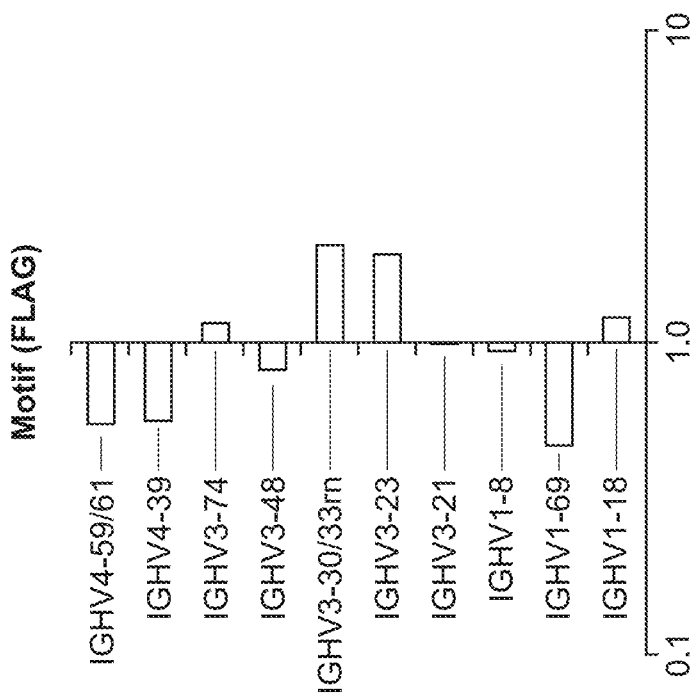
FIG. 18E is a plot of heavy chain frameworks assayed for expression.

Following de novo synthesis, 10 variant sequences were generated for the variable domain, heavy chain 602, 236 variant sequences were generated for the heavy chain complementarity determining region 3 604, and 43 variant sequences were designed for a region comprising the variable domain 606, light chain and CDR-L3 and of which 9 variants for variable domain, light chain were designed. This resulted in a library with about $10^5$ diversity (10×236×43). This was confirmed using next generation sequencing (NGS) with 16 million reads. As seen in FIG. 14, the normalized sequencing reads for each of the 10 variants for the variable domain, heavy chain was about 1. As seen in FIG. 15, the normalized sequencing reads for each of the 43 variants for the variable domain, light chain was about 1. As seen in FIG. 16, the normalized sequencing reads for 236 variant sequences for the heavy chain complementarity determining region 3 were about 1.

The various light and heavy chains were then tested for expression and protein folding. Referring to FIGS. 17A-17D, the 10 variant sequences for variable domain, heavy chain included the following: IGHV1-18, IGHV1-69, IGHV1-8 IGHV3-21, IGHV3-23, IGHV3-30/33m, IGHV3-28, IGHV3-74, IGHV4-39, and IGHV4-59/61. Of the 10 variant sequences, IGHV1-18, IGHV1-69, and IGHV3-30/33m exhibited improved characteristics such as improved thermostability. Referring to FIGS. 18A-18F, 9 variant sequences for variable domain, light chain included the following: IGKV1-39, IGKV1-9, IGKV2-28, IGKV3-11, IGKV3-15, IGKV3-20, IGKV4-1, IGLV1-51, and IGLV2-14. Of the 9 variant sequences, IGKV1-39, IGKV3-15, IGLV1-51, and IGLV2-14 exhibited improved characteristics such as improved thermostability.

Example 10: Expression of GPCR Antibody Libraries in HEK293 Cells

Following generation of GPCR antibody libraries as in Example 13, about 47 GPCRs were selected for screening. GPCR constructs about 1.8 kb to about 4.5 kb in size were designed in a pCDNA3.1 vector. The GPCR constructs were then synthesized following similar methods as described in Examples 2-4 including hierarchal assembly. Of the 47 GPCR constructs, 46 GPCR constructs were synthesized.

The synthesized GPCR constructs were transfected in HEK293 and assayed for expression using immunofluorescence. Referring to FIGS. 19A-19C, HEK293 cells were transfected with the GPCR constructs comprising an N-terminally hemagglutinin (HA)-tagged human $Y_1$ receptor. Following 24-48 hours of transfection, cells were washed with phosphate buffered saline (PBS) and fixed with 4% paraformaldehyde. Cells were stained using fluorescent primary antibody directed towards the HA tag or secondary antibodies comprising a fluorophore and DAPI to visualize the nuclei in blue. Referring to FIGS. 19A-19C, human $Y_1$ receptor was visualized on the cell surface in non-permeabilized cells and on the cell surface and intracellularly in permeabilized cells.

GPCR constructs were also visualized by designing GPCR constructs comprising auto-fluorescent proteins. Referring to FIGS. 20A-20C, human $Y_1$ receptor comprised EYFP fused to its C-terminus, and human $Y_5$ receptor comprised ECFP fused to its C-terminus. HEK293 cells were transfected with human $Y_1$ receptor or co-transfected with human $Y_1$ receptor and human $Y_5$ receptor. Following transfection cells were washed and fixed with 4% paraformaldehyde. Cells were stained with DAPI. Localization of human $Y_1$ receptor and human $Y_5$ receptor were visualized by fluorescence microscopy.

Example 11: Design of Immunoglobulin Library

Figure 21A:
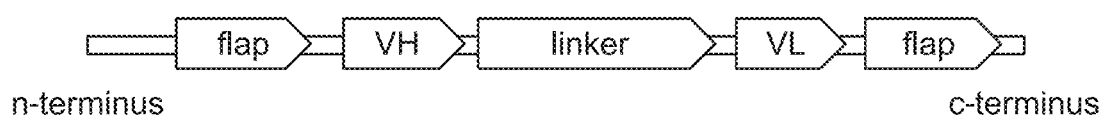
FIG. 21A depicts a schematic of an immunoglobulin scaffold comprising a VH domain attached to a VL domain using a linker.
Figure 21B:
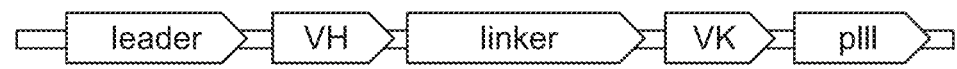
FIG. 21B depicts a schematic of a full-domain architecture of an immunoglobulin scaffold comprising a VH domain attached to a VL domain using a linker, a leader sequence, and pIII sequence.

An immunoglobulin scaffold library was designed for placement of GPCR binding domains and for improving stability for a range of GPCR binding domain encoding sequences. The immunoglobulin scaffold included a VH domain attached with a VL domain with a linker. Variant nucleic acid sequences were generated for the framework elements and CDR elements of the VH domain and VL domain. The structure of the design is shown in FIG. 21A. A full domain architecture is shown in FIG. 21B. Sequences for the leader, linker, and pIII are listed in Table 11.

TABLE 11

Nucleotide sequences

| SEQ ID NO | Domain | Sequence |
|---|---|---|
| 88 | Leader | GCAGCCGCTGGCTTGCTGCTGCTGGCAGCTCAGCCGGCCATGGCC |
| 89 | Linker | GCTAGCGGTGGAGGCGGTTCAGGCGGAGGTGGCTCTGGCGGTGGC GGATCGCATGCATCC |
| 90 | pIII | CGCGCGGCCGCTGGAAGCGGCTCCCACCATCACCATCACCAT |

The VL domains that were designed include IGKV1-39, IGKV3-15, IGLV1-51, and IGLV2-14. Each of four VL domains were assembled with their respective invariant four framework elements (FW1, FW2, FW3, FW4) and variable 3 CDR (L1, L2, L3) elements. For IGKV1-39, there was 490 variants designed for L1, 420 variants designed for L2, and 824 variants designed for L3 resulting in a diversity of $1.7 \times 10^8$ (490*420*824). For IGKV3-15, there was 490 variants designed for L1, 265 variants designed for L2, and 907 variants designed for L3 resulting in a diversity of $1.2 \times 10^8$ (490*265*907). For IGLV1-51, there was 184 variants designed for L1, 151 variants designed for L2, and 824 variants designed for L3 resulting in a diversity of $2.3 \times 10^7$ (184*151*824). IGLV2-14, 967 variants designed for L1, 535 variants designed for L2, and 922 variants designed for L3 resulting in a diversity of $4.8\ 10^8$ (967*535*922). Table 12 lists the amino acid sequences and nucleotide sequences for the four framework elements (FW1, FW2, FW3, FW4) for IGLV1-51. Table 13 lists the variable 3 CDR (L1, L2, L3) elements for IGLV1-51. Variant amino acid sequences and nucleotide sequences for the four framework elements (FW1, FW2, FW3, FW4) and the variable 3 CDR (L1, L2, L3) elements were also designed for IGKV1-39, IGKV3-15, and IGLV2-14.

TABLE 12

Sequences for IGLV1-51 framework elements

| Element | SEQ ID NO | Amino Acid Sequence | SEQ ID NO | Nucleotide Sequence |
|---|---|---|---|---|
| IGLV1-51 | | | | |
| FW1 | 91 | QSVLTQPPSVSAAPGQKVTISC | 92 | CAGTCTGTGTTGACGCAGCCGCCCTCAGTGTCTGCGGCCCCAGGACAGAAGGTCACCATCTCCTGC |
| FW2 | 93 | WYQQLPGTAPKLLIY | 94 | TGGTATCAGCAGCTCCCAGGAACAGCCCCCAAACTCCTCATTTAT |
| FW3 | 95 | GIPDRFSGSKSGTSATLGITGLQTGDEADYY | 96 | GGGATTCCTGACCGATTCTCTGGCTCCAAGTCTGGCACGTCAGCCACCCTGGGCATCACCGGACTCCAGACTGGGGACGAGGCCGATTATTAC |
| FW4 | 97 | GGGTKLTVL | 98 | GGCGGAGGGACCAAGCTGACCGTCCTA |

TABLE 13

Sequences for IGLV1-51 CDR elements

| SEQ ID NO | Amino Acid Sequence | SEQ ID NO | Nucleotide Sequence |
|---|---|---|---|
| IGLV1-51-L1 | | | |
| 99 | SGSSSNIGSNHVS | 282 | TCTGGAAGCAGCTCCAACATTGGGAGTAATCATGTATCC |
| 100 | SGSSSNIGNNYLS | 283 | TCTGGAAGCAGCTCCAACATTGGGAATAATTATCTATCC |
| 101 | SGSSSNIANNYVS | 284 | TCTGGAAGCAGCTCCAACATTGCGAATAATTATGTATCC |
| 102 | SGSSPNIGNNYVS | 285 | TCTGGAAGCAGCCCCAACATTGGGAATAATTATGTATCG |
| 103 | SGSRSNIGSNYVS | 286 | TCTGGAAGCAGATCCAATATTGGGAGTAATTATGTTTCG |
| 104 | SGSSSNVGDNYVS | 287 | TCTGGAAGCAGCTCCAACGTTGGCGATAATTATGTTTCC |
| 105 | SGSSSNIGIQYVS | 288 | TCTGGAAGCAGCTCCAACATTGGGATTCAATATGTATCC |
| 106 | SGSSSNVGNNFVS | 289 | TCTGGAAGCAGCTCCAATGTTGGTAACAATTTTGTCTCC |
| 107 | SGSASNIGNNYVS | 290 | TCTGGAAGCGCCTCCAACATTGGGAATAATTATGTATCC |
| 108 | SGSGSNIGNDVS | 291 | TCTGGAAGCGGCTCCAATATTGGGAATAATGATGTGTCC |
| 109 | SGSISNIGNNYVS | 292 | TCTGGAAGCATCTCCAACATTGGTAATAATTATGTATCC |
| 110 | SGSISNIGKNYVS | 293 | TCTGGAAGCATCTCCAACATTGGGAAAATTATGTGTCG |
| 111 | SGSSSNIGHNYVS | 294 | TCTGGAAGCAGCTCCAACATTGGGCATAATTATGTATCG |
| 112 | PGSSSNIGNNYVS | 295 | CCTGGAAGCAGCTCCAACATTGGGAATAATTATGTATCC |
| 113 | SGSTSNIGIHYVS | 296 | TCTGGAAGCACCTCCAACATTGGAATTCATTATGTATCC |

TABLE 13-continued

Sequences for IGLV1-51 CDR elements

| SEQ ID NO | Amino Acid Sequence | SEQ ID NO | Nucleotide Sequence |
|---|---|---|---|
| 114 | SGSSSNIGSHYVS | 297 | TCTGGAAGCAGCTCCAACATTGGCAGTCATTATGTTTCC |
| 115 | SGSSSNIGNEYVS | 298 | TCCGGAAGCAGCTCCAACATTGGAAATGAATATGTATCC |
| 116 | SGSTSNIGNNYIS | 299 | TCTGGAAGCACCTCCAACATTGGAAATAATTATATATCG |
| 117 | SGSSSNIGNHFVS | 300 | TCTGGAAGCAGCTCCAATATTGGGAATCATTTTGTATCG |
| 118 | SGSSSNIGNNYVA | 301 | TCTGGAAGCAGCTCCAACATTGGGAATAATTATGTGGCC |
| 119 | SGSSSNIGSYYVS | 302 | TCTGGAAGCAGCTCCAACATTGGAAGTTATTATGTATCC |
| 120 | SGSGFNIGNNYVS | 303 | TCTGGAAGTGGTTTCAACATTGGGAATAATTATGTCTCT |
| 121 | SGSTSNIGNNYVS | 304 | TCTGGAAGCACCTCCAACATTGGGAATAATTATGTGTCC |
| 122 | SGSSSDIGNNYVS | 305 | TCTGGAAGCAGCTCCGACATTGGCAATAATTATGTATCC |
| 123 | SGSSSNIGNNVVS | 306 | TCTGGAAGCAGCTCCAACATTGGGAATAATGTTGTATCC |
| 124 | SGSKSNIGKNYVS | 307 | TCTGGAAGCAAGTCTAACATTGGGAAAAATTATGTATCC |
| 125 | SGSSTNIGNNYVS | 308 | TCTGGAAGCAGCACCAACATTGGGAATAATTATGTATCC |
| 126 | SGSISNIGDNYVS | 309 | TCTGGAAGCATCTCCAACATTGGGGATAATTATGTATCC |
| 127 | SGSSSNIGSKDVS | 310 | TCTGGAAGCAGCTCCAACATTGGGAGTAAGGATGTATCA |
| 128 | SGSSSNIENNDVS | 311 | TCTGGAAGCAGCTCCAACATTGAGAATAATGATGTATCG |
| 129 | SGSSSNIGNHYVS | 312 | TCTGGAAGCAGCTCCAACATTGGGAATCATTATGTATCC |
| 130 | SGSSSNIGKDFVS | 313 | TCTGGAAGCAGCTCCAACATTGGGAAGGATTTTGTCTCC |
| 131 | SGSTSNIGSNFVS | 314 | TCTGGCAGTACTTCCAACATCGGAAGTAATTTTGTTTCC |
| 132 | SGSTSNIGHNYVS | 315 | TCTGGAAGCACCTCCAACATTGGGCATAATTATGTATCC |
| 133 | SASSSNIGNNYVS | 316 | TCTGCAAGCAGCTCCAACATTGGGAATAATTATGTATCC |
| 134 | SGSSSIGNNYVS | 317 | TCTGGAAGCAGCTCCAGCATTGGCAATAATTATGTATCC |
| 135 | SGSSSTIGNNYVS | 318 | TCTGGAAGCAGCTCCACCATTGGGAATAATTATGTATCC |
| 136 | SGSSSNIENNYVS | 319 | TCTGGAAGCAGCTCCAACATTGAAAATAATTATGTATCC |
| 137 | SGSSSNIGNQYVS | 320 | TCTGGAAGCAGCTCCAACATTGGGAATCAGTATGTATCC |
| 138 | SGSSSNIGNNYVF | 321 | TCTGGAAGCAGCTCCAACATTGGGAATAATTATGTATTC |

TABLE 13-continued

Sequences for IGLV1-51 CDR elements

| SEQ ID NO | Amino Acid Sequence | SEQ ID NO | Nucleotide Sequence |
|---|---|---|---|
| 139 | SGSSSNIGRNYVS | 322 | TCTGGAAGCAGCTCCAACATTGGGAGGAATTATGTCTCC |
| 140 | SGGSSNIGNYYVS | 323 | TCTGGAGGCAGCTCCAACATTGGAAATTATTATGTATCG |
| 141 | SGSSSNIGDNYVS | 324 | TCTGGAAGCAGCTCCAACATTGGAGATAATTATGTCTCC |
| 142 | SGGSSNIGINYVS | 325 | TCTGGAGGCAGCTCCAACATTGGAATTAATTATGTATCC |
| 143 | SGGSSNIGKNYVS | 326 | TCTGGAGGCAGCTCCAACATTGGGAAGAATTATGTATCC |
| 144 | SGSSSNIGKRSVS | 327 | TCTGGAAGCAGCTCCAACATTGGGAAGAGATCTGTATCG |
| 145 | SGSRSNIGNNYVS | 328 | TCTGGAAGCAGATCCAACATTGGGAATAACTATGTATCC |
| 146 | SGSSSNIGNNLVS | 329 | TCGGGAAGCAGCTCCAACATTGGGAATAATCTTGTTTCC |
| 147 | SGSSSNIGINYVS | 330 | TCTGGAAGCAGCTCCAACATTGGGATCAATTATGTATCC |
| 148 | SGSSSNIGNFVS | 331 | TCTGGAAGCAGCTCCAACATCGGGAATAATTTTGTATCC |
| 149 | SGTSSNIGRNFVS | 332 | TCTGGAACCAGCTCCAACATTGGCAGAAATTTTGTATCC |
| 150 | SGRRSNIGNNYVS | 333 | TCTGGAAGGAGGTCCAACATTGGAAATAATTATGTGTCC |
| 151 | SGGSFNIGNNYVS | 334 | TCTGGAGGCAGCTTCAATATTGGGAATAATTATGTATCC |
| 152 | SGSTSNIGENYVS | 335 | TCTGGAAGCACTTCCAACATTGGGGAGAATTATGTGTCC |
| 153 | SGSSSNIGSDYVS | 336 | TCTGGAAGCAGCTCCAATATTGGGAGTGATTATGTATCC |
| 154 | SGTSSNIGSNYVS | 337 | TCTGGAACCAGCTCCAACATTGGGAGTAATTATGTATCC |
| 155 | SGSSSNIGTNFVS | 338 | TCTGGAAGCAGCTCCAACATTGGGACTAATTTTGTATCC |
| 156 | SGSSSNFGNNYVS | 339 | TCTGGAAGCAGCTCCAACTTTGGGAATAATTATGTATCC |
| 157 | SGSTSNIGNNHVS | 340 | TCTGGAAGCACCTCCAACATTGGGAATAATCATGTATCC |
| 158 | SGSSSNIGNDFVS | 341 | TCTGGAAGCAGCTCCAACATTGGGAATGATTTTGTATCC |
| 159 | SGSSSDIGDNYVS | 342 | TCTGGAAGCAGCTCCGACATTGGCGATAATTATGTGTCC |
| 160 | SGSSSNIGKYYVS | 343 | TCTGGAAGCAGCTCCAACATTGGGAAATATTATGTATCC |
| 161 | SGSSSNIGGNYVS | 344 | TCTGGAAGCAGCTCCAACATTGGCGGTAATTATGTATCC |
| 162 | SGSSSNTGNNYVS | 345 | TCTGGAAGCAGCTCCAACACTGGGAATAATTATGTATCC |
| 163 | SGSSSNVGNNYVS | 346 | TCTGGAAGCAGCTCCAACGTTGGGAATAATTATGTGTCT |

TABLE 13-continued

Sequences for IGLV1-51 CDR elements

| SEQ ID NO | Amino Acid Sequence | SEQ ID NO | Nucleotide Sequence |
|---|---|---|---|
| 164 | SGSSSNIANNFVS | 347 | TCTGGAAGCAGCTCCAACATTGCGAATAATTTTGTATCC |
| 165 | SGSSSNIGNDYVS | 348 | TCTGGAAGCAGCTCCAACATTGGGAATGATTATGTATCC |
| 166 | SGSTSNIENNYVS | 349 | TCTGGAAGCACCTCCAATATTGAGAATAATTATGTTTCC |
| 167 | SGGSSNIGNNDVS | 350 | TCTGGAGGCAGCTCCAATATTGGCAATAATGATGTGTCC |
| 168 | SGSTSNIGNHYVS | 351 | TCTGGAAGCACCTCCAACATTGGGAATCATTATGTATCC |
| 169 | SGSSSNIGDNDVS | 352 | TCAGGAAGCAGCTCCAATATTGGGGATAATGATGTATCC |
| 170 | SGYSSNIGNNYVS | 353 | TCTGGATACAGCTCCAACATTGGGAATAATTATGTATCC |
| 171 | SGSGSNIGNNFVS | 354 | TCTGGAAGCGGCTCCAACATTGGAAATAATTTTGTATCC |
| 172 | SGSSSNIWNNYVS | 355 | TCTGGAAGCAGCTCCAACATTTGGAATAATTATGTATCC |
| 173 | FGSSSNIGNNYVS | 356 | TTTGGAAGCAGCTCCAACATTGGGAATAATTATGTATCC |
| 174 | SGSSSNIEKNYVS | 357 | TCTGGAAGCAGCTCCAACATTGAGAAGAATTATGTATCC |
| 175 | SGSRSNIGNYYVS | 358 | TCTGGAAGTAGATCCAATATTGGAAATTATTATGTATCC |
| 176 | SGTKSNIGNNYVS | 359 | TCTGGAACCAAGTCAAACATTGGGAATAATTATGTATCT |
| 177 | SGSTSNIGNYYVS | 360 | TCTGGAAGCACCTCCAACATTGGGAATTATTATGTATCC |
| 178 | SGTSSNIGNNYVA | 361 | TCTGGAACCAGCTCCAACATTGGGAATAATTATGTGGCC |
| 179 | PGTSSNIGNNYVS | 362 | CCTGGAACCAGCTCCAACATTGGGAATAATTATGTATCC |
| 180 | SGSTSNIGINYVS | 363 | TCCGGAAGCACCTCCAACATTGGGATTAATTATGTATCC |
| 181 | SGSSSNIGSNLVS | 364 | TCTGGAAGCAGCTCCAACATTGGGAGTAATCTGGTATCC |
| 182 | SGSSSNIENNHVS | 365 | TCTGGAAGCAGCTCCAACATTGAGAATAATCATGTATCC |
| 183 | SGTRSNIGNNYVS | 366 | TCTGGAACCAGGTCCAACATCGGCAATAATTATGTTTCG |
| 184 | SGSTSNIGDNYVS | 367 | TCTGGAAGCACCTCCAACATTGGGGACAATTATGTTTCC |
| 185 | SGGSSNIGKNFVS | 368 | TCTGGAGGCAGTTCCAACATTGGGAAGAATTTTGTATCC |
| 186 | SGSRSDIGNNYVS | 369 | TCTGGAAGCAGGTCCGACATTGGGAATAATTATGTATCC |
| 187 | SGTSSNIGNNDVS | 370 | TCTGGAACTAGCTCCAACATTGGGAATAATGATGTATCC |
| 188 | SGSSSNIGSKYVS | 371 | TCTGGAAGCAGCTCCAACATTGGGAGTAAATATGTATCA |

TABLE 13-continued

Sequences for IGLV1-51 CDR elements

| SEQ ID NO | Amino Acid Sequence | SEQ ID NO | Nucleotide Sequence |
|---|---|---|---|
| 189 | SGSSFNIGNNYVS | 372 | TCTGGAAGCAGCTTCAACATTGGGAATAATTATGTATCC |
| 190 | SGSSSNIGNTYVS | 373 | TCTGGAAGCAGCTCCAACATTGGGAATACTTATGTATCC |
| 191 | SGSSSNIGDNHVS | 374 | TCTGGAAGCAGCTCCAATATTGGGGATAATCATGTATCC |
| 192 | SGSSSNIGNNHVS | 375 | TCTGGAAGCAGCTCCAACATTGGCAATAATCATGTTTCC |
| 193 | SGSTSNIGNNDVS | 376 | TCTGGAAGCACCTCCAACATTGGGAATAATGATGTATCC |
| 194 | SGSRSNVGNNYVS | 377 | TCTGGAAGCAGATCCAACGTTGGCAATAATTATGTTTCA |
| 195 | SGGTSNIGKNYVS | 378 | TCCGGAGGCACCTCCAACATTGGGAAGAATTATGTGTCT |
| 196 | SGSSSNIADNYVS | 379 | TCTGGAAGCAGCTCCAACATTGCCGATAATTATGTTTCC |
| 197 | SGSSSNIGANYVS | 380 | TCTGGAAGCAGCTCCAACATTGGCGCCAATTATGTATCC |
| 198 | SGSSSNIGSNYVA | 381 | TCTGGAAGCAGCTCCAACATTGGGAGTAATTATGTGGCC |
| 199 | SGSSSNIGNNFLS | 382 | TCTGGAAGCAGCTCCAACATTGGGAACAATTTTCTCTCC |
| 200 | SGRSSNIGKNYVS | 383 | TCTGGAAGAAGCTCCAACATTGGGAAGAATTATGTATCC |
| 201 | SGSSPNIGANYVS | 384 | TCTGGAAGCAGCCCCAACATTGGGGCTAATTATGTATCC |
| 202 | SGSSSNIGPNYVS | 385 | TCCGGAAGCAGCTCCAACATTGGGCCTAATTATGTGTCC |
| 203 | SGSSSTIGNNYIS | 386 | TCTGGAAGCAGCTCCACCATTGGGAATAATTATATATCC |
| 204 | SGSSSNIGNYFVS | 387 | TCTGGAAGCAGCTCCAACATTGGGAATTATTTTGTATCC |
| 205 | SGSRSNIGNNFVS | 388 | TCTGGAAGCCGCTCCAACATTGGTAATAATTTTGTATCC |
| 206 | SGGSSNIGSNFVS | 389 | TCTGGAGGCAGCTCCAACATTGGGAGTAATTTTGTATCC |
| 207 | SGSSSNIGYNYVS | 390 | TCTGGAAGCAGCTCCAACATTGGGTATAATTATGTATCC |
| 208 | SGTSSNIENNYVS | 391 | TCTGGAACCAGCTCGAACATTGAGAACAATTATGTATCC |
| 209 | SGSSSNIGNYYVS | 392 | TCTGGAAGTAGCTCCAACATTGGGAATTATTATGTATCC |
| 210 | SGSTSNIGKNYVS | 393 | TCTGGAAGCACCTCCAACATTGGGAAGAATTATGTATCC |
| 211 | SGSSSNIGTYYVS | 394 | TCTGGAAGCAGTTCCAACATTGGGACTTATTATGTCTCT |
| 212 | SGSSSNVGKNYVS | 395 | TCTGGAAGCAGCTCCAACGTTGGGAAAAATTATGTATCT |
| 213 | SGSTSNIGDNFVS | 396 | TCTGGAAGCACCTCCAACATTGGGGATAATTTTGTATCC |

TABLE 13-continued

Sequences for IGLV1-51 CDR elements

| SEQ ID NO | Amino Acid Sequence | SEQ ID NO | Nucleotide Sequence |
|---|---|---|---|
| 214 | SGSTSNIGTNYVS | 397 | TCTGGAAGCACCTCCAACATTGGAACTAATTATGTTTCC |
| 215 | SGGTSNIGNNYVS | 398 | TCTGGAGGTACTTCCAACATTGGGAATAATTATGTCTCC |
| 216 | SGSYSNIGNNYVS | 399 | TCTGGAAGCTACTCCAATATTGGGAATAATTATGTATCC |
| 217 | SGSSSNIEDNYVS | 400 | TCTGGAAGCAGCTCCAACATTGAAGATAATTATGTATCC |
| 218 | SGSSSNIGKHYVS | 401 | TCTGGAAGCAGCTCCAACATTGGGAAACATTATGTATCC |
| 219 | SGSGSNIGSNYVS | 402 | TCCGGTTCCGGCTCAAACATTGGAAGTAATTATGTCTCC |
| 220 | SGSSSNIGNNYIS | 403 | TCTGGAAGCAGCTCCAACATTGGAAATAATTATATATCA |
| 221 | SGASSNIGNNYVS | 404 | TCTGGAGCCAGTTCCAACATTGGGAATAATTATGTTTCC |
| 222 | SGRTSNIGNNYVS | 405 | TCTGGACGCACCTCCAACATCGGGAACAATTATGTATCC |
| 223 | SGGSSNIGSNYVS | 406 | TCTGGAGGCAGCTCCAATATTGGGAGTAATTACGTATCC |
| 224 | SGSGSNIGNNYVS | 407 | TCTGGAAGCGGCTCCAACATTGGGAATAATTATGTATCC |
| 225 | SGSTSNIGSNYVS | 408 | TCTGGAAGCACCTCCAACATTGGGAGTAATTATGTATCC |
| 226 | SGSSSSIGNNYVA | 409 | TCTGGAAGCAGCTCCAGCATTGGGAATAATTATGTGGCG |
| 227 | SGSSSNLGNNYVS | 410 | TCTGGAAGCAGTTCCAACCTTGGAAATAATTATGTATCC |
| 228 | SGTSSNIGKNYVS | 411 | TCTGGAACCAGCTCCAACATTGGGAAAAATTATGTATCC |
| 229 | SGSSSDIGNKYIS | 412 | TCTGGAAGCAGCTCCGATATTGGGAACAAGTATATATCC |
| 230 | SGSSSNIGSNYIS | 413 | TCTGGAAGCAGCTCCAACATTGGAAGTAATTACATATCC |
| 231 | SGSTSNIGANYVS | 414 | TCTGGAAGCACCTCCAACATTGGGGCTAACTATGTGTCC |
| 232 | SGSSSNIGNKYVS | 415 | TCTGGAAGCAGCTCCAACATTGGGAATAAGTATGTATCC |
| 233 | SGSSSNIGNNYGS | 416 | TCTGGAAGCAGCTCCAACATTGGGAATAATTATGGATCC |
| 234 | SGSTSNIANNYVS | 417 | TCTGGAAGCACCTCCAACATTGCGAATAATTATGTATCC |
| 235 | SGSYSNIGSNYVS | 418 | TCTGGAAGCTACTCCAATATTGGGAGTAATTATGTATCC |
| 236 | SGSSSNIGSNFVS | 419 | TCTGGAAGCAGCTCCAACATTGGGAGTAATTTTGTATCC |
| 237 | SGSSSNLENNYVS | 420 | TCTGGAAGCAGCTCCAATCTTGAGAATAATTATGTATCC |
| 238 | SGSISNIGSNYVS | 421 | TCTGGAAGCATCTCCAATATTGGCAGTAATTATGTATCC |

TABLE 13-continued

Sequences for IGLV1-51 CDR elements

| SEQ ID NO | Amino Acid Sequence | SEQ ID NO | Nucleotide Sequence |
|---|---|---|---|
| 239 | SGSSSDIGSNYVS | 422 | TCTGGAAGCAGCTCCGACATTGGGAGTAATTATGTATCC |
| 240 | SGSSSNIGTNYVS | 423 | TCTGGAAGCAGCTCCAACATTGGGACTAATTATGTATCC |
| 241 | SGSSSNIGKNFVS | 424 | TCTGGAAGCAGCTCCAACATTGGGAAGAATTTTGTATCC |
| 242 | SGSSSNIGNNFIS | 425 | TCTGGAAGCAGCTCCAACATTGGGAATAATTTTATATCC |
| 243 | SGGSSNIGNNYVS | 426 | TCTGGAGGCAGCTCCAACATTGGCAATAATTATGTTTCC |
| 244 | SGSSSNIGENYVS | 427 | TCTGGAAGCAGCTCCAACATTGGGGAGAATTATGTATCC |
| 245 | SGSSSNIGNNFVA | 428 | TCTGGAAGCAGCTCCAATATTGGGAATAATTTTGTGGCC |
| 246 | SGGSSNIGNNYVA | 429 | TCTGGAGGCAGCTCCAACATTGGGAATAATTATGTAGCC |
| 247 | SGSSSHIGNNYVS | 430 | TCTGGAAGCAGCTCCCACATTGGAAATAATTATGTATCC |
| 248 | SGSSSNIGSNDVS | 431 | TCTGGAAGCAGCTCCAATATTGGAAGTAATGATGTATCG |
| 249 | SGSSSNIGNNYVT | 432 | TCTGGAAGCAGCTCCAACATTGGGAATAATTATGTAACC |
| 250 | SGSSSNIGNNPVS | 433 | TCTGGAAGCAGCTCCAACATTGGGAATAATCCTGTATCC |
| 251 | SGGSSNIGNHYVS | 434 | TCTGGAGGCAGCTCCAATATTGGGAATCATTATGTATCC |
| 252 | SGTSSNIGNNYVS | 435 | TCTGGAACCAGCTCCAACATTGGGAATAATTATGTATCC |
| 253 | SGSSSNIGSNYVS | 436 | TCTGGAAGCAGCTCCAACATTGGAAGTAATTATGTCTCG |
| 254 | SGGTSNIGSNYVS | 437 | TCTGGAGGCACCTCCAACATTGGAAGTAATTATGTATCC |
| 255 | SGSKSNIGNNYVS | 438 | TCTGGAAGCAAGTCCAACATTGGGAATAATTATGTATCC |
| 256 | SGRSSNIGNNYVS | 439 | TCTGGAAGAAGCTCCAACATTGGGAATAATTATGTATCG |
| 257 | SGSSSNVGSNYVS | 440 | TCTGGAAGCAGCTCCAACGTTGGGAGTAATTATGTTTCC |
| 258 | SGSTSNIGNNFVS | 441 | TCTGGAAGCACCTCCAATATTGGGAATAATTTTGTATCC |
| 259 | SGSNFIGNNYVS | 442 | TCTGGAAGCAACTTCAACATTGGGAATAATTATGTCTCC |
| 260 | SGSTSNIGYNYVS | 443 | TCTGGAAGCACCTCCAATATTGGATATAATTATGTATCC |
| 261 | SGSSSNIVSNYVS | 444 | TCTGGAAGCAGCTCCAATATTGTAAGTAATTATGTATCC |
| 262 | SGTSSNIGNNFVS | 445 | TCTGGAACCAGCTCCAACATTGGGAATAATTTTGTATCC |
| 263 | SGSSSNIGRNFVS | 446 | TCTGGAAGCAGCTCCAACATTGGGAGGAATTTTGTGTCC |

TABLE 13-continued

Sequences for IGLV1-51 CDR elements

| SEQ ID NO | Amino Acid Sequence | SEQ ID NO | Nucleotide Sequence |
|---|---|---|---|
| 264 | SGTTSNIGNNYVS | 447 | TCTGGAACGACCTCCAACATTGGGAATAATTATGTCTCC |
| 265 | SGSSSNIGNNDVS | 448 | TCTGGAAGCAGCTCCAACATTGGGAATAATGATGTATCC |
| 266 | SGSSSNIGNHDVS | 449 | TCTGGAAGCAGCTCCAACATTGGGAATCATGATGTATCC |
| 267 | SGSSSNIGSSHVS | 450 | TCTGGAAGCAGCTCCAACATTGGAAGTAGTCATGTATCC |
| 268 | SGSSSNIGIHYVS | 451 | TCTGGAAGCAGCTCCAACATTGGGATTCATTATGTATCC |
| 269 | SGGGSNIGYNYVS | 452 | TCTGGAGGCGGCTCCAACATTGGCTATAATTATGTCTCC |
| 270 | SGSSSNIGDHYVS | 453 | TCTGGAAGCAGCTCCAACATTGGGGATCATTATGTGTCG |
| 271 | SGSSSNLGKNYVS | 454 | TCTGGAAGCAGCTCCAACCTTGGGAAGAATTATGTATCT |
| 272 | SGSSSNIGDNFVS | 455 | TCTGGAAGCAGCTCCAACATTGGCGATAATTTTGTATCC |
| 273 | SGSTSNIEKNYVS | 456 | TCTGGAAGCACCTCCAACATTGAGAAAAACTATGTATCG |
| 274 | SGSSSNIGKDYVS | 457 | TCTGGAAGCAGCTCCAACATTGGGAAGGATTATGTATCC |
| 275 | SGSSSNIGKNYVS | 458 | TCTGGAAGCAGCTCCAACATTGGGAAGAATTATGTATCC |
| 276 | SGSSSNIGNNYVS | 459 | TCTGGAAGCAGCTCCAACATTGGGAATAATTATGTATCC |
| 277 | SGSSSNIGNYAS | 460 | TCTGGAAGCAGCTCCAACATTGGGAATAATTATGCCTCC |
| 278 | SGISSNIGNNYVS | 461 | TCTGGAATCAGCTCCAACATTGGGAATAATTATGTATCC |
| 279 | TGSSSNIGNNYVS | 462 | ACTGGAAGCAGCTCCAACATTGGGAATAATTATGTATCC |
| 280 | SGTSSNIGNNHVS | 463 | TCTGGAACCAGCTCCAACATTGGGAATAATCATGTTTCC |
| 281 | SGSRSNIGKNYVS | 464 | TCTGGAAGTCGTTCCAACATTGGGAAAAATTATGTATCC |

IGLV1-51-L2

| 465 | DNNKRPP | 616 | GACAATAATAAGCGACCCCCA |
| 466 | ENNRRPS | 617 | GAGAATAATAGGCGACCCTCA |
| 467 | DNNKQPS | 618 | GACAATAATAAGCAACCCTCA |
| 468 | DNNKRPL | 619 | GACAATAACAAGCGACCCTTG |
| 469 | DNDKRPA | 620 | GACAATGATAAGCGACCCGCA |
| 470 | DNHERPS | 621 | GACAATCATGAGCGACCCTCA |
| 471 | ENRKRPS | 622 | GAAAACCGTAAGCGACCCTCA |
| 472 | DNDQRPS | 623 | GACAATGATCAGCGACCCTCA |
| 473 | ENYKRPS | 624 | GAGAATTATAAGCGACCCTCA |
| 474 | ENTKRPS | 625 | GAAAATACTAAGCGACCCTCA |

TABLE 13-continued

Sequences for IGLV1-51 CDR elements

| SEQ ID NO | Amino Acid Sequence | SEQ ID NO | Nucleotide Sequence |
|---|---|---|---|
| 475 | DTEKRPS | 626 | GACACTGAGAAGAGGCCCTCA |
| 476 | DNDKRPP | 627 | GACAATGATAAGCGACCCCCA |
| 477 | DHNKRPS | 628 | GACCATAATAAGCGACCCTCA |
| 478 | GNNERPS | 629 | GGCAATAATGAGCGACCCTCA |
| 479 | DTSKRPS | 630 | GACACTAGTAAGCGACCCTCA |
| 480 | EYNKRPS | 631 | GAATATAATAAGCGCCCCTCA |
| 481 | ENIKRPS | 632 | GAAAATATTAAGCGACCCTCA |
| 482 | DNVKRPS | 633 | GACAATGTTAAGCGACCCTCA |
| 483 | ENDKRSS | 634 | GAAAACGATAAACGATCCTCA |
| 484 | ENNKRHS | 635 | GAAAATAATAAGCGACACTCA |
| 485 | GNDQRPS | 636 | GGAAATGATCAGCGACCCTCA |
| 486 | DNDRRPS | 637 | GACAATGATAGGCGACCCTCA |
| 487 | DNHKRPS | 638 | GACAATCATAAGCGGCCCTCA |
| 488 | DNNDRPS | 639 | GACAATAATGACCGACCCTCA |
| 489 | ENNQRPS | 640 | GAGAATAATCAGCGACCCTCA |
| 490 | DNNQRPS | 641 | GACAATAATCAGCGACCCTCA |
| 491 | ENVKRPS | 642 | GAGAATGTTAAGCGACCCTCA |
| 492 | DTYKRPS | 643 | GACACTTATAAGAGACCCTCA |
| 493 | NNNNRPS | 644 | AACAATAATAACCGACCCTCA |
| 494 | GNNNRPS | 645 | GGCAATAATAATCGACCCTCA |
| 495 | ENDQRPS | 646 | GAAAATGATCAGCGACCCTCA |
| 496 | DNNKRAS | 647 | GACAATAATAAGCGAGCCTCA |
| 497 | DNDKRPL | 648 | GACAATGATAAGCGACCCTTA |
| 498 | DTDERPS | 649 | GACACTGATGAGCGACCTTCA |
| 499 | DNRKRPS | 650 | GACAATAGGAAGCGACCCTCA |
| 500 | DNDARPS | 651 | GACAATGATGCTCGACCCTCA |
| 501 | DNNKRLS | 652 | GACAATAATAAGCGACTCTCA |
| 502 | DNDKRAS | 653 | GACAATGATAAGCGAGCCTCA |
| 503 | DNTERPS | 654 | GACAATACTGAGCGACCCTCA |
| 504 | DNNIRPS | 655 | GACAATAATATTCGACCCTCA |
| 505 | DNKRRPS | 656 | GACAATAAGAGGCGACCCTCA |
| 506 | DDNNRPS | 657 | GACGATAATAACCGACCCTCA |
| 507 | ANNRRPS | 658 | GCGAATAATCGACGACCCTCA |
| 508 | DNDKRLS | 659 | GACAATGATAAGCGACTGTCA |
| 509 | DNNKRPA | 660 | GACAATAATAAGCGACCCGCA |
| 510 | DNYRRPS | 661 | GACAATTATAGACGTCCCTCA |
| 511 | ANDQRPS | 662 | GCCAATGATCAGCGACCCTCA |

TABLE 13-continued

Sequences for IGLV1-51 CDR elements

| SEQ ID NO | Amino Acid Sequence | SEQ ID NO | Nucleotide Sequence |
|---|---|---|---|
| 512 | DNDKRRS | 663 | GACAATGATAAGCGACGCTCA |
| 513 | DKNERPS | 664 | GACAAGAATGAGCGACCCTCA |
| 514 | DNKERPS | 665 | GACAATAAGGAGCGACCCTCA |
| 515 | DNNKGPS | 666 | GACAATAATAAGGGACCCTCA |
| 516 | ENDRRPS | 667 | GAAAATGATAGACGACCCTCA |
| 517 | ENDERPS | 668 | GAAAATGATGAGCGACCCTCA |
| 518 | QNNKRPS | 669 | CAAAATAATAAGCGACCCTCA |
| 519 | DNRERPS | 670 | GACAATCGTGAGCGACCCTCA |
| 520 | DNNRRPS | 671 | GACAATAATAGACGACCCTCA |
| 521 | GNNRRPS | 672 | GGAAATAATAGGCGACCCTCA |
| 522 | DNDNRPS | 673 | GACAATGATAACCGACCCTCA |
| 523 | EDNKRPS | 674 | GAAGATAATAAGCGACCCTCA |
| 524 | DDDERPS | 675 | GACGATGATGAGCGGCCCTCA |
| 525 | ASNKRPS | 676 | GCAAGTAATAAGCGACCCTCA |
| 526 | DNNKRSS | 677 | GACAATAATAAGCGATCCTCA |
| 527 | QNNERPS | 678 | CAAAATAATGAGCGACCCTCA |
| 528 | DDDRRPS | 679 | GACGATGATAGGCGACCCTCA |
| 529 | NNDKRPS | 680 | AACAATGATAAGCGACCCTCA |
| 530 | DNNNRPS | 681 | GACAATAATAACCGACCCTCA |
| 531 | DNNVRPS | 682 | GACAATAATGTGCGACCCTCA |
| 532 | ENNERPS | 683 | GAAAATAATGAGCGACCCTCA |
| 533 | DNNHRPS | 684 | GACAATAATCACCGACCCTCA |
| 534 | DNDERPS | 685 | GACAATGATGAGCGCCCCTCG |
| 535 | DNIRRPS | 686 | GACAATATCCGGCGACCCTCA |
| 536 | DFNKRPS | 687 | GACTTTAATAAGCGACCCTCA |
| 537 | ETNKRPS | 688 | GAAACTAATAAGCGACCCTCA |
| 538 | NDNKRPS | 689 | AACGATAATAAGCGACCCTCA |
| 539 | DDNKRPS | 690 | GACGATAATAAGCGACCCTCA |
| 540 | DNYKRPS | 691 | GACAATTATAAGCGACCCTCA |
| 541 | HNNKRPS | 692 | CACAATAATAAGCGACCCTCA |
| 542 | DNHQRPS | 693 | GACAATCATCAGCGACCCTCA |
| 543 | DNYKRAS | 694 | GACAATTATAAGCGAGCCTCA |
| 544 | DNIKRPS | 695 | GACAATATTAAGCGACCCTCA |
| 545 | DTHKRPS | 696 | GACACTCATAAGCGACCCTCA |
| 546 | DTNRRPS | 697 | GACACTAATAGGCGACCCTCT |
| 547 | DTNQRPS | 698 | GACACTAATCAGCGACCCTCA |
| 548 | ESDKRPS | 699 | GAAAGTGATAAGCGACCCTCA |
| 549 | DNDKRSS | 700 | GACAATGATAAGCGATCTTCG |

TABLE 13-continued

Sequences for IGLV1-51 CDR elements

| SEQ ID NO | Amino Acid Sequence | SEQ ID NO | Nucleotide Sequence |
|---|---|---|---|
| 550 | GSNKRPS | 701 | GGCAGTAATAAGCGACCCTCA |
| 551 | DNNKRVS | 702 | GACAATAACAAGCGAGTTTCA |
| 552 | NNNRRPS | 703 | AACAATAATAGGCGACCCTCA |
| 553 | DNFKRPS | 704 | GACAATTTTAAGCGACCCTCA |
| 554 | ENDKRPS | 705 | GAAAATGATAAACGACCCTCA |
| 555 | ENNKRLS | 706 | GAAAATAATAAGCGACTCTCA |
| 556 | ADNKRPS | 707 | GCAGATAATAAGCGACCCTCA |
| 557 | EDNERPS | 708 | GAAGATAATGAGCGCCCCTCA |
| 558 | DTDQRPS | 709 | GACACTGATCAGCGACCCTCA |
| 559 | DNYQRPS | 710 | GACAATTATCAGCGACCCTCA |
| 560 | DENKRPS | 711 | GACGAGAATAAGCGACCCTCA |
| 561 | DTNKRPS | 712 | GACACTAATAAGCGACCCTCA |
| 562 | DDYRRPS | 713 | GACGATTATCGGCGACCCTCA |
| 563 | DNDKRHS | 714 | GACAACGATAAGCGGCACTCA |
| 564 | ENDNRPS | 715 | GAAAATGATAATCGACCCTCA |
| 565 | DDNERPS | 716 | GACGATAATGAGCGCCCCTCA |
| 566 | DNKKRPS | 717 | GACAATAAGAAGCGACCCTCA |
| 567 | DVDKRPS | 718 | GACGTTGATAAGCGACCCTCA |
| 568 | ENKKRPS | 719 | GAAAATAAAAAACGACCCTCT |
| 569 | VNDKRPS | 720 | GTCAATGATAAGCGACCCTCA |
| 570 | DNDHRPS | 721 | GACAATGATCACCGACCCTCA |
| 571 | DINKRPS | 722 | GACATTAATAAGCGACCCTCA |
| 572 | ANNERPS | 723 | GCCAATAATGAGCGACCCTCA |
| 573 | DNENRPS | 724 | GACAATGAAAACCGACCGTCA |
| 574 | GDDKRPS | 725 | GGCGATGATAAGCGACCCTCA |
| 575 | ANNQRPS | 726 | GCCAATAATCAGCGACCTTCA |
| 576 | DDDKRPS | 727 | GACGATGATAAGCGACCCTCA |
| 577 | YNNKRPS | 728 | TACAATAATAAGCGGCCCTCA |
| 578 | EDDKRPS | 729 | GAAGATGATAAGCGACCCTCA |
| 579 | ENNNRPS | 730 | GAAAACAATAACCGACCCTCG |
| 580 | DNNLRPS | 731 | GACAATAATCTGCGACCCTCA |
| 581 | ESNKRPS | 732 | GAGAGTAACAAGCGACCCTCA |
| 582 | DTDKRPS | 733 | GACACTGATAAGCGGCCCTCA |
| 583 | DDDQRPS | 734 | GACGATGATCAGCGACCCTCA |
| 584 | VNNKRPS | 735 | GTGAATAATAAGAGACCCTCC |
| 585 | DDYKRPS | 736 | GACGATTATAAGCGACCCTCA |
| 586 | DNTKRPS | 737 | GACAATACTAAGCGACCCTCA |

TABLE 13-continued

Sequences for IGLV1-51 CDR elements

| SEQ ID NO | Amino Acid Sequence | SEQ ID NO | Nucleotide Sequence |
|---|---|---|---|
| 587 | DDTERPS | 738 | GACGATACTGAGCGACCCTCA |
| 588 | GNDKRPS | 739 | GGCAATGATAAGCGACCCTCA |
| 589 | DNEKRPS | 740 | GACAATGAAAAGCGACCCTCA |
| 590 | DNDDRPS | 741 | GACAATGATGACCGACCCTCA |
| 591 | DDNRRPS | 742 | GACGATAATAGGCGTCCCTCA |
| 592 | GNNKRPS | 743 | GGCAATAATAAGCGACCCTCA |
| 593 | ANDKRPS | 744 | GCCAATGATAAGCGACCCTCA |
| 594 | DNNKRHS | 745 | GACAATAATAAGCGACACTCA |
| 595 | DDNQRPS | 746 | GACGACAATCAGCGACCCTCA |
| 596 | GNDRRPS | 747 | GGCAATGATAGGCGACCCTCA |
| 597 | DNHNRPS | 748 | GACAATCATAACCGACCCTCA |
| 598 | DNYERPS | 749 | GACAATTATGAGCGACCCTCA |
| 599 | ENNKRSS | 750 | GAAAATAATAAGCGATCCTCA |
| 600 | DDHKRPS | 751 | GACGATCATAAGCGGCCCTCA |
| 601 | DNNKRRS | 752 | GACAATAATAAACGACGTTCA |
| 602 | DNDKRPS | 753 | GACAATGATAAGCGACCGTCA |
| 603 | DKNKRPS | 754 | GACAAGAATAAGCGACCCTCA |
| 604 | DNNKRPS | 755 | GACAATAATAAGCGACCCTCA |
| 605 | DIDKRPS | 756 | GACATTGATAAGCGACCCTCA |
| 606 | DDKKRPS | 757 | GACGATAAGAAGCGACCCTCA |
| 607 | ANNKRPS | 758 | GCCAATAATAAGCGACCCTCA |
| 608 | DNDKGPS | 759 | GACAATGATAAGGGACCCTCA |
| 609 | EDNRRPS | 760 | GAAGATAATAGGCGACCCTCA |
| 610 | ENNKRPS | 761 | GAGAATAATAAGCGACCCTCA |
| 611 | NNNKRPS | 762 | AACAATAATAAGCGACCCTCA |
| 612 | DNNERPS | 763 | GACAATAATGAGCGACCCTCA |
| 613 | DNIQRPS | 764 | GACAATATTCAGCGACCCTCA |
| 614 | DNNYRPS | 765 | GACAATAATTACCGACCCTCA |
| 615 | DNYNRPS | 766 | GACAATTATAACCGACCCTCA |
| IGLV1-51-L3 | | | |
| 767 | CGTWDTSLSAVVF | 1591 | TGCGGAACATGGGATACCAGCCTGAGTGCTGTGGTGTTC |
| 768 | CGTWDTSLSAGVF | 1592 | TGCGGAACATGGGATACCAGCCTGAGTGCTGGGGTGTTC |
| 769 | CGTWDTSLSAWVF | 1593 | TGCGGAACATGGGATACCAGCCTGAGTGCTTGGGTGTTC |
| 770 | CGTWDRSLSAGVF | 1594 | TGCGGAACATGGGATAGGAGCCTGAGTGCGGGGGTGTTC |
| 771 | CGTWDRSLSAWVF | 1595 | TGCGGAACATGGGATAGGAGCCTGAGTGCTTGGGTATTT |

TABLE 13-continued

Sequences for IGLV1-51 CDR elements

| SEQ ID NO | Amino Acid Sequence | SEQ ID NO | Nucleotide Sequence |
|---|---|---|---|
| 772 | CGTWDTSLSGGVF | 1596 | TGCGGAACATGGGATACCAGCCTGAGTGGTGGGGTGTTC |
| 773 | CGTWDTSLRAGVF | 1597 | TGCGGAACATGGGATACTAGCCTGCGTGCTGGCGTCTTC |
| 774 | CGTWDRSLSVWVF | 1598 | TGCGGAACATGGGATAGGAGCCTGAGTGTTTGGGTGTTC |
| 775 | CGTWDTSLSVVVF | 1599 | TGCGGAACATGGGATACCAGTCTGAGTGTTGTGGTCTTC |
| 776 | CGTWDTSLSAAVF | 1600 | TGCGGAACGTGGGATACCAGCCTGAGTGCTGCGGTGTTC |
| 777 | CGAWDTSLSAGVF | 1601 | TGCGGAGCATGGGATACCAGCCTGAGTGCTGGAGTGTTC |
| 778 | CATWDTSLSAVVF | 1602 | TGCGCAACATGGGATACCAGCCTGAGTGCTGTGGTATTC |
| 779 | CATWDTSLSAGVF | 1603 | TGCGCAACATGGGATACCAGCCTGAGTGCTGGTGTGTTC |
| 780 | CGTWESSLSAWVF | 1604 | TGTGGAACATGGGAGAGCAGCCTGAGTGCTTGGGTGTTC |
| 781 | CGTWDTTLSAGVF | 1605 | TGCGGAACATGGGATACCACCCTGAGTGCGGGTGTCTTC |
| 782 | CGTWDTSLSVWVF | 1606 | TGCGGAACATGGGATACTAGCCTGAGTGTGTGGGTGTTC |
| 783 | CGTWDTSLSVGVF | 1607 | TGCGGAACATGGGATACTAGCCTGAGTGTTGGGGTGTTC |
| 784 | CGTWDTSLSTGVF | 1608 | TGCGGAACATGGGACACCAGTCTGAGCACTGGCGTCTTC |
| 785 | CGTWDTSLSGVVF | 1609 | TGCGGAACATGGGATACCAGCCTGAGTGGTGTGGTCTTC |
| 786 | CGTWDTSLSAYVF | 1610 | TGCGGAACATGGGATACCAGCCTGAGTGCTTATGTCTTC |
| 787 | CGTWDTSLSAEVF | 1611 | TGCGGAACATGGGATACCAGCCTGAGTGCTGAGGTGTTC |
| 788 | CGTWDTGLSAGVF | 1612 | TGCGGAACATGGGATACCGGCCTGAGTGCTGGGGTATTC |
| 789 | CGTWDRSLSAYVF | 1613 | TGCGGAACGTGGGATAGGAGCCTGAGTGCTTATGTCTTC |
| 790 | CGTWDRSLSAVVF | 1614 | TGCGGAACATGGGATAGGAGCCTCAGTGCCGTGGTATTC |
| 791 | CGTWDNTLSAWVF | 1615 | TGCGGAACATGGGATAACACCCTGAGTGCGTGGGTGTTC |
| 792 | CGTWDNRLSAGVF | 1616 | TGCGGAACATGGGATAACAGGCTGAGTGCTGGGGTGTTC |
| 793 | CGTWDISLSAWVF | 1617 | TGCGGAACATGGGACATCAGCCTGAGTGCTTGGGTGTTC |
| 794 | CGTWHSSLSAGVF | 1618 | TGCGGAACATGGCATAGCAGCCTGAGTGCTGGGGTATTC |
| 795 | CGTWGSSLSAWVF | 1619 | TGCGGAACATGGGGTAGCAGTTTGAGTGCTTGGGTGTTC |
| 796 | CGTWESSLSGWVF | 1620 | TGCGGAACATGGGAGAGCAGCCTGAGTGGTTGGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 797 | CGTWESSLSAVVF | 1621 | TGCGGAACATGGGAGAGCAGCCTGAGTGCTGTGGTTTTC |
| 798 | CGTWDYSLSAVVF | 1622 | TGCGGAACATGGGATTACAGCCTGAGTGCTGTGGTATTC |
| 799 | CGTWDYSLSAGVF | 1623 | TGCGGAACATGGGATTACAGCCTGAGTGCTGGGGTATTC |
| 800 | CGTWDVSLSVGVF | 1624 | TGCGGAACATGGGATGTCAGCCTGAGTGTTGGAGTGTTC |
| 801 | CGTWDTTLSAVVF | 1625 | TGCGGAACATGGGATACCACCCTGAGTGCTGTGGTTTTC |
| 802 | CGTWDTTLNIGVF | 1626 | TGCGGAACATGGGATACCACTCTGAATATTGGGGTGTTC |
| 803 | CGTWDTSLTAVVF | 1627 | TGCGGAACATGGGATACCAGCCTGACTGCTGTGGTATTC |
| 804 | CGTWDTSLTAAVF | 1628 | TGCGGAACCTGGGATACCAGCCTGACTGCTGCTGTGTTC |
| 805 | CGTWDTSLSVGLF | 1629 | TGCGGCACATGGGATACCAGCCTGAGTGTGGGGCTATTC |
| 806 | CGTWDTSLSGRVF | 1630 | TGCGGAACCTGGGATACCAGCCTGAGTGGTAGGGTGTTC |
| 807 | CGTWDTSLSGAVF | 1631 | TGCGGAACATGGGATACCAGCCTGAGTGGTGCAGTGTTC |
| 808 | CGTWDTSLSAGLF | 1632 | TGCGGAACATGGGATACCAGCCTGAGTGCTGGCCTGTTC |
| 809 | CGTWDTSLSAGGVF | 1633 | TGCGGAACATGGGATACCAGCCTGAGTGCTGGAGGGGTCTTC |
| 810 | CGTWDTSLRAYVF | 1634 | TGCGGAACATGGGATACCAGCCTGCGTGCTTATGTCTTC |
| 811 | CGTWDTSLRAWVF | 1635 | TGCGGAACATGGGATACTAGTTTGCGTGCTTGGGTATTC |
| 812 | CGTWDTSLNTGVF | 1636 | TGCGGAACATGGGATACCAGCCTGAATACTGGGGTATTC |
| 813 | CGTWDTSLNIWVF | 1637 | TGCGGAACATGGGATACCAGCCTGAATATTTGGGTGTTC |
| 814 | CGTWDTSLNIGVF | 1638 | TGCGGAACATGGGATACAAGCCTGAATATTGGGGTGTTC |
| 815 | CGTWDTSLIAVVF | 1639 | TGCGGAACATGGGATACCAGCCTGATTGCTGTGGTGTTC |
| 816 | CGTWDRSLSGWVF | 1640 | TGCGGAACGTGGGATAGGAGCCTGAGTGGTTGGGTGTTC |
| 817 | CGTWDNRLSGWVF | 1641 | TGCGGAACATGGGATAACAGGCTGAGTGGTTGGGTGTTC |
| 818 | CGTWDKSLSAVVF | 1642 | TGCGGAACGTGGGATAAGAGCCTGAGTGCTGTGGTCTTC |
| 819 | CGTWDKGLSAWVF | 1643 | TGCGGAACATGGGATAAAGGCCTGAGTGCTTGGGTGTTC |
| 820 | CGTWDISLSAGVF | 1644 | TGCGGAACATGGGATATCAGCCTGAGTGCTGGGGTGTTC |
| 821 | CGTWDESLSGGEVVF | 1645 | TGCGGAACATGGGATGAGAGCCTGAGTGGTGGCGAGGTGGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 822 | CGTWDASLSAWVF | 1646 | TGCGGAACATGGGATGCCAGCCTGAGTGCCTGGGTGTTC |
| 823 | CGTWDAGLSAWVF | 1647 | TGCGGAACTTGGGATGCCGGCCTGAGTGCTTGGGTGTTC |
| 824 | CGAWDTSLSAWVF | 1648 | TGCGGAGCATGGGATACCAGCCTGAGTGCTTGGGTGTTC |
| 825 | CGAWDTSLSAVVF | 1649 | TGCGGAGCATGGGATACCAGCCTGAGTGCTGTGGTGTTC |
| 826 | CGAWDTSLRAGVF | 1650 | TGCGGAGCATGGGATACCAGCCTGCGTGCTGGGGTTTTC |
| 827 | CATWDTSVSAWVF | 1651 | TGCGCAACATGGGATACCAGCGTGAGTGCTTGGGTGTTC |
| 828 | CATWDTSLSAWVF | 1652 | TGCGCAACATGGGATACCAGCCTGAGTGCGTGGGTGTTC |
| 829 | CATWDNTLSAGVF | 1653 | TGCGCAACATGGGACAACACCCTGAGTGCTGGGGTGTTC |
| 830 | CAAWDRSLSVWVF | 1654 | TGCGCAGCATGGGATAGGAGCCTGAGTGTTTGGGTGTTC |
| 831 | CYTWHSSLRGGVF | 1655 | TGCTACACATGGCATTCCAGTCTGCGTGGTGGGGTGTTC |
| 832 | CVTWTSSPSAWVF | 1656 | TGCGTAACGTGGACTAGTAGCCCGAGTGCTTGGGTGTTC |
| 833 | CVTWRGGLVLF | 1657 | TGCGTGACATGGCGTGGTGGCCTTGTGTTGTTC |
| 834 | CVTWDTSLTSVVL | 1658 | TGCGTAACATGGGATACCAGCCTGACTTCTGTGGTACTC |
| 835 | CVTWDTSLSVYWVF | 1659 | TGCGTAACATGGGATACCAGCCTGAGTGTTTATTGGGTGTTC |
| 836 | CVTWDTSLSAWVF | 1660 | TGCGTTACATGGGATACCAGCCTGAGTGCCTGGGTGTTC |
| 837 | CVTWDTDLSVALF | 1661 | TGCGTCACATGGGATACCGACCTCAGCGTTGCGCTCTTC |
| 838 | CVTWDRSLSGWVF | 1662 | TGCGTAACATGGGATAGGAGCCTGAGTGGTTGGGTGTTC |
| 839 | CVTWDRSLREVLF | 1663 | TGCGTAACATGGGATCGCAGCCTGAGAGAGGTGTTATTC |
| 840 | CVTWDRSLRAVVF | 1664 | TGCGTAACATGGGATCGCAGCCTGAGAGCGGTGGTATTC |
| 841 | CVTWDRSLDAGVF | 1665 | TGCGTAACATGGGACAGGAGCCTCGATGCTGGGGTTTTC |
| 842 | CVTWDNTLSAGVF | 1666 | TGCGTGACATGGGATAACACCCTGAGTGCTGGGGTCTTC |
| 843 | CVTWDNNLFGVVF | 1667 | TGCGTAACATGGGATAACAACCTGTTTGGTGTGGTCTTC |
| 844 | CVSWDTSLSGAVF | 1668 | TGCGTATCATGGGATACCAGCCTGAGTGGTGCGGTATTC |
| 845 | CVSWDTSLSAGVF | 1669 | TGCGTCTCATGGGATACCAGCCTGAGTGCTGGGGTATTC |
| 846 | CTTWFRTPSDVVF | 1670 | TGCACAACATGGTTTAGGACTCCGAGTGATGTGGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 847 | CTTWFRTASDVVF | 1671 | TGCACAACATGGTTTAGGACTGCGAGTGATGTGGTCTTC |
| 848 | CTTWDYGLSVVF | 1672 | TGCACAACGTGGGATTACGGTCTGAGTGTCGTCTTC |
| 849 | CTARDTSLSPGGVF | 1673 | TGCACAGCAAGGGATACCAGCCTGAGTCCTGGCGGGGTCTTC |
| 850 | CSTWNTRPSDVVF | 1674 | TGCTCAACATGGAATACGAGGCCGAGTGATGTGGTGTTC |
| 851 | CSTWESSLTTVVF | 1675 | TGTTCAACATGGGAGAGCAGTTTGACTACTGTGGTCTTC |
| 852 | CSTWDTSLTNVLF | 1676 | TGCTCAACATGGGATACCAGCCTCACTAATGTGCTATTC |
| 853 | CSTWDTSLSGVVF | 1677 | TGCTCAACATGGGATACCAGCCTGAGTGGAGTAGTCTTC |
| 854 | CSTWDHSLKAALF | 1678 | TGCTCAACATGGGATCACAGCCTGAAAGCTGCACTGTTC |
| 855 | CSTWDARLSVRVF | 1679 | TGCTCAACCTGGGATGCGAGGCTGAGTGTCCGGGTGTTC |
| 856 | CSSYTSSSTWVF | 1680 | TGCTCCTCATATACAAGCAGCAGCACTTGGGTGTTC |
| 857 | CSSYATRGLRVLF | 1681 | TGCAGCTCATACGCAACCCGCGGCCTTCGTGTGTTGTTC |
| 858 | CSSWDATLSVRIF | 1682 | TGTTCATCATGGGACGCCACCCTGAGTGTTCGCATATTC |
| 859 | CQVWEGSSDHWVF | 1683 | TGTCAGGTGTGGGAGGGTAGTAGTGATCATTGGGTGTTC |
| 860 | CQTWDNRLSAVVF | 1684 | TGCCAAACCTGGGATAACAGACTGAGTGCTGTGGTGTTC |
| 861 | CQTWDHSLHVGVF | 1685 | TGTCAAACGTGGGATCACAGCCTGCATGTTGGGGTGTTC |
| 862 | CQSYDDILNVWVL | 1686 | TGCCAGTCCTATGACGACATCTTGAATGTTTGGGTCCTT |
| 863 | CNTWDKSLTSELF | 1687 | TGCAATACATGGGATAAGAGTTTGACTTCTGAACTCTTC |
| 864 | CLTWDRSLNVRVF | 1688 | TGCTTAACATGGGATCGCAGCCTGAATGTGAGGGTGTTC |
| 865 | CLTWDHSLTAYVF | 1689 | TGCCTAACATGGGACCACAGCCTGACTGCTTATGTCTTC |
| 866 | CLTRDTSLSAPVF | 1690 | TGCTTAACAAGGGATACCAGTCTGAGTGCCCCTGTGTTC |
| 867 | CKTWESGLNFGHVF | 1691 | TGCAAAACATGGGAAAGTGGCCTTAATTTTGGCCACGTCTTC |
| 868 | CKTWDTSLSAVVF | 1692 | TGCAAAACATGGGATACCAGCCTGAGTGCTGTGGTCTTC |
| 869 | CGVWDVSLGAGVF | 1693 | TGCGGAGTCTGGGATGTCAGTCTGGGTGCTGGGGTGTTC |
| 870 | CGVWDTTPSAVLF | 1694 | TGCGGAGTCTGGGATACCACCCCGAGTGCCGTTCTTTTC |
| 871 | CGVWDTTLSAVLF | 1695 | TGCGGAGTCTGGGATACCACCCTGAGTGCCGTTCTTTTC |

TABLE 13-continued

Sequences for IGLV1-51 CDR elements

| SEQ ID NO | Amino Acid Sequence | SEQ ID NO | Nucleotide Sequence |
|---|---|---|---|
| 872 | CGVWDTSLGVF | 1696 | TGCGGAGTATGGGATACCAGCCTGGGGGTCTTC |
| 873 | CGVWDTNLGKWVF | 1697 | TGCGGGGTATGGGATACCAACCTGGGTAAATGGGTTTTC |
| 874 | CGVWDTGLDAGWVF | 1698 | TGTGGAGTTTGGGATACTGGCCTGGATGCTGGTTGGGTGTTC |
| 875 | CGVWDNVLEAYVF | 1699 | TGCGGAGTGTGGGATAACGTCCTGGAGGCCTATGTCTTC |
| 876 | CGVWDISLSANWVF | 1700 | TGCGGAGTCTGGGATATCAGCCTGAGTGCTAATTGGGTGTTC |
| 877 | CGVWDHSLGIWAF | 1701 | TGCGGAGTATGGGATCACAGCCTGGGGATTTGGGCCTTC |
| 878 | CGVWDDILTAEVF | 1702 | TGCGGAGTTTGGGATGATATTCTGACTGCTGAAGTGTTC |
| 879 | CGVRDTSLGVF | 1703 | TGCGGAGTTCGGGATACCAGCCTGGGGGTCTTC |
| 880 | CGTYDTSLPAWVF | 1704 | TGCGGAACATACGATACGAGCCTGCCTGCTTGGGTGTTT |
| 881 | CGTYDNLVFGYVF | 1705 | TGCGGAACTTACGATAATCTTGTATTTGGTTATGTCTTC |
| 882 | CGTYDDRLREVF | 1706 | TGCGGAACATACGATGATAGACTCAGAGAGGTGTTC |
| 883 | CGTWVTSLSAGVF | 1707 | TGCGGAACGTGGGTTACCAGCCTGAGTGCTGGGGTGTTC |
| 884 | CGTWVSSLTTVVF | 1708 | TGCGGAACATGGGTTAGCAGCCTGACTACTGTAGTATTC |
| 885 | CGTWVSSLNVWVF | 1709 | TGCGGAACATGGGTTAGCAGCCTGAACGTCTGGGTGTTC |
| 886 | CGTWVGRFWVF | 1710 | TGCGGAACATGGGTTGGCAGGTTTTGGGTATTC |
| 887 | CGTWSGGPSGHWLF | 1711 | TGCGGAACATGGTCTGGCGGCCCGAGTGGCCATTGGTTGTTC |
| 888 | CGTWSGGLSGHWLF | 1712 | TGCGGAACATGGTCTGGCGGCCTGAGTGGCCATTGGTTGTTC |
| 889 | CGTWQTGREAVLF | 1713 | TGCGGAACGTGGCAGACCGGCCGGGAGGCTGTCCTATTT |
| 890 | CGTWQSRLRWVF | 1714 | TGCGGAACGTGGCAGAGCAGGCTGAGGTGGGTGTTC |
| 891 | CGTWQSRLGWVF | 1715 | TGCGGAACGTGGCAGAGCAGGCTGGGGTGGGTGTTC |
| 892 | CGTWPRSLSAVWVF | 1716 | TGCGGAACATGGCCTAGGAGCCTGAGTGCTGTTTGGGTGTTC |
| 893 | CGTWNNYLSAGDVVF | 1717 | TGCGGAACATGGAATAACTACCTGAGTGCTGGCGATGTGGTTTTC |
| 894 | CGTWLGSQSPYWVF | 1718 | TGCGGAACATGGCTTGGCAGCCAGAGTCCTTATTGGGTCTTC |
| 895 | CGTWHTGLSAYVF | 1719 | TGCGGAACATGGCATACCGGCCTGAGTGCTTATGTCTTC |
| 896 | CGTWHSTLSAGHWVF | 1720 | TGCGGAACATGGCATAGTACCCTGAGTGCTGGCCATTGGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 897 | CGTWHSSLSTWVF | 1721 | TGCGGAACATGGCATAGTAGCCTGAGTACTTGGGTGTTC |
| 898 | CGTWHSSLSAYVF | 1722 | TGCGGAACATGGCATAGCAGCCTGAGTGCCTATGTCTTC |
| 899 | CGTWHSSLSAVVF | 1723 | TGCGGAACATGGCATAGCAGCCTGAGTGCTGTGGTATTC |
| 900 | CGTWHSGLSGWVF | 1724 | TGCGGAACGTGGCATTCCGGCCTGAGTGGGTGGGTTTTC |
| 901 | CGTWHNTLRNVIF | 1725 | TGCGGAACATGGCATAACACCCTGCGTAATGTGATATTC |
| 902 | CGTWHASLTAVF | 1726 | TGCGGAACATGGCATGCCAGCCTGACTGCTGTGTTC |
| 903 | CGTWGWYGSQRGVVF | 1727 | TGCGGGACATGGGGATGGTATGGCAGCCAGAGAGGCGTCGTCTTC |
| 904 | CGTWGWYGGQRGVVF | 1728 | TGCGGGACATGGGGATGGTATGGCGGCCAGAGAGGCGTCGTCTTC |
| 905 | CGTWGTSLSAWVF | 1729 | TGCGGAACCTGGGGAACCAGCCTGAGTGCTTGGGTGTTC |
| 906 | CGTWGSSLTTGLF | 1730 | TGCGGAACCTGGGGTAGCAGCCTGACTACTGGCCTGTTC |
| 907 | CGTWGSSLTAYVF | 1731 | TGCGGAACATGGGGTAGCAGCCTGACTGCCTATGTCTTC |
| 908 | CGTWGSSLSVVF | 1732 | TGCGGAACATGGGGTAGCAGCCTGAGTGTTGTGTTC |
| 909 | CGTWGSSLSGGVF | 1733 | TGCGGAACATGGGGTAGCAGCCTGAGTGGTGGGGTGTTC |
| 910 | CGTWGSSLSAYWVF | 1734 | TGCGGAACATGGGGTAGCAGCCTGAGTGCTTATTGGGTGTTC |
| 911 | CGTWGSSLSAYVVF | 1735 | TGCGGAACATGGGGTAGCAGCCTGAGTGCTTATGTGGTGTTC |
| 912 | CGTWGSSLSAYVF | 1736 | TGCGGAACATGGGGTAGCAGCCTGAGTGCTTATGTCTTC |
| 913 | CGTWGSSLSAVVF | 1737 | TGCGGAACGTGGGGTAGTAGCCTGAGTGCTGTGGTGTTC |
| 914 | CGTWGSSLSAPYVF | 1738 | TGCGGAACATGGGGTAGCAGCCTGAGTGCTCCTTATGTCTTC |
| 915 | CGTWGSSLSAPVF | 1739 | TGCGGAACATGGGGTAGCAGCCTGAGTGCCCCGGTGTTC |
| 916 | CGTWGSSLSAGVF | 1740 | TGCGGAACATGGGGTAGCAGCCTGAGTGCTGGGGTGTTC |
| 917 | CGTWGSSLSAGLF | 1741 | TGCGGAACTTGGGGTAGCAGCCTGAGTGCTGGACTGTTC |
| 918 | CGTWGSSLSAGALF | 1742 | TGCGGAACATGGGGTAGCAGCCTGAGTGCTGGGGCACTCTTC |
| 919 | CGTWGSSLRAWVF | 1743 | TGCGGAACATGGGGCAGTAGCCTGCGTGCTTGGGTGTTC |
| 920 | CGTWFTSLASGVF | 1744 | TGCGGAACCTGGTTTACTAGTCTGGCTAGTGGGGTTTTC |
| 921 | CGTWETSLSVVVI | 1745 | TGCGGAACTTGGGAGACCAGTCTGAGTGTCGTGGTCATC |

TABLE 13-continued

Sequences for IGLV1-51 CDR elements

| SEQ ID NO | Amino Acid Sequence | SEQ ID NO | Nucleotide Sequence |
|---|---|---|---|
| 922 | CGTWETSLSGVF | 1746 | TGCGGAACATGGGAGACCAGCCTGAGTGGTGTCTTC |
| 923 | CGTWETSLSDWVF | 1747 | TGCGGAACATGGGAAACCAGCCTGAGTGATTGGGTATTC |
| 924 | CGTWETSLSAGVF | 1748 | TGCGGAACATGGGAGACCAGCCTGAGTGCTGGGGTATTC |
| 925 | CGTWETSLNYVAF | 1749 | TGCGGAACATGGGAAACCAGCCTTAATTATGTGGCCTTC |
| 926 | CGTWETSLNTWLL | 1750 | TGCGGAACATGGGAGACCAGCCTGAATACTTGGTTGCTC |
| 927 | CGTWETSESGNYIF | 1751 | TGCGGAACATGGGAGACCAGCGAGAGTGGTAATTACATCTTC |
| 928 | CGTWETRLGTWVI | 1752 | TGCGGAACATGGGAAACCAGACTGGGTACTTGGGTGATC |
| 929 | CGTWETQLYWVF | 1753 | TGCGGAACATGGGAGACCCAGTTATATTGGGTGTTC |
| 930 | CGTWETGLSAGEVF | 1754 | TGCGGAACATGGGAGACTGGCCTAAGTGCTGGAGAGGTGTTC |
| 931 | CGTWESTLSVFLF | 1755 | TGCGGAACTTGGGAAAGCACCCTGAGTGTTTTCCTATTC |
| 932 | CGTWESSLTVVVF | 1756 | TGCGGGACATGGGAAAGTAGCCTGACTGTTGTGGTCTTC |
| 933 | CGTWESSLTGVVF | 1757 | TGCGGAACATGGGAAAGTAGCCTGACTGGAGTGGTATTC |
| 934 | CGTWESSLTGFVF | 1758 | TGCGGAACATGGGAAAGCAGCCTGACTGGTTTTGTCTTC |
| 935 | CGTWESSLSVGVF | 1759 | TGTGGAACATGGGAGAGCAGCCTGAGTGTTGGGGTGTTC |
| 936 | CGTWESSLSEWVF | 1760 | TGCGGAACCTGGGAAAGTAGCCTCAGTGAATGGGTGTTC |
| 937 | CGTWESSLSAVF | 1761 | TGCGGAACATGGGAGAGCAGCCTGAGTGCTGTATTC |
| 938 | CGTWESSLSAGYIF | 1762 | TGCGGAACATGGGAGAGCAGCCTGAGTGCTGGTTATATCTTC |
| 939 | CGTWESSLSAGVF | 1763 | TGCGGAACATGGGAGAGCAGCCTGAGTGCTGGAGTGTTC |
| 940 | CGTWESSLSAGPVF | 1764 | TGCGGAACATGGGAAAGCAGCCTGAGCGCTGGCCCGGTGTTC |
| 941 | CGTWESSLSAGGQVF | 1765 | TGCGGAACATGGGAAAGCAGCCTGAGTGCTGGAGGCCAGGTGTTC |
| 942 | CGTWESSLSAFGGYVF | 1766 | TGCGGAACATGGGAGAGCAGCCTGAGTGCCTTCGGCGGTTATGTCTTC |
| 943 | CGTWESSLRVWVF | 1767 | TGCGGAACATGGGAAAGCAGCCTGAGGGTTTGGGTGTTC |
| 944 | CGTWESSLFTGPWVF | 1768 | TGCGGAACATGGGAAAGCAGCCTCTTTACTGGGCCTTGGGTGTTC |
| 945 | CGTWESLSATYVF | 1769 | TGCGGAACATGGGAGAGCCTGAGTGCCACCTATGTCTTC |
| 946 | CGTWESGLSAGVF | 1770 | TGCGGAACATGGGAGAGCGGCCTGAGTGCTGGTGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 947 | CGTWESDFWVF | 1771 | TGCGGAACATGGGAAAGCGACTTTTGGGTGTTT |
| 948 | CGTWENRLSAVVF | 1772 | TGCGGTACATGGGAAAACAGACTGAGTGCTGTGGTCTTC |
| 949 | CGTWENRLSAGVF | 1773 | TGCGGAACATGGGAAAACAGACTGAGTGCCGGGGTATTC |
| 950 | CGTWEISLTTSVVF | 1774 | TGCGGAACATGGGAAATCAGCCTGACTACTTCTGTGGTATTC |
| 951 | CGTWEISLSTSVVF | 1775 | TGCGGAACATGGGAAATCAGCCTGAGTACTTCTGTGGTATTC |
| 952 | CGTWEGSLSVVF | 1776 | TGCGGAACATGGGAAGGCAGCCTCAGTGTTGTTTTC |
| 953 | CGTWEGSLRVF | 1777 | TGCGGAACATGGGAAGGCAGCCTGAGGGTGTTC |
| 954 | CGTWEGSLRHVF | 1778 | TGCGGAACATGGGAGGGCAGCCTGAGGCACGTGTTC |
| 955 | CGTWDYSPVRAGVF | 1779 | TGCGGAACATGGGATTACAGCCCTGTACGTGCTGGGGTGTTC |
| 956 | CGTWDYSLSVYLF | 1780 | TGCGGAACGTGGGATTACAGCCTGAGTGTTTATCTCTTC |
| 957 | CGTWDYSLSSGVVF | 1781 | TGCGGAACATGGGATTACAGCCTGAGTTCTGGCGTGGTATTC |
| 958 | CGTWDYSLSAWVF | 1782 | TGCGGAACATGGGATTACAGCCTGAGTGCCTGGGTGTTC |
| 959 | CGTWDYSLSAEVF | 1783 | TGCGGAACATGGGATTACAGTCTGAGTGCTGAGGTGTTC |
| 960 | CGTWDYSLRRAIF | 1784 | TGCGGAACATGGGATTACAGCCTGCGTCGTGCGATATTC |
| 961 | CGTWDWSLILQLF | 1785 | TGCGGAACATGGGATTGGAGCCTCATTCTTCAATTGTTC |
| 962 | CGTWDVTLHTGVF | 1786 | TGCGGAACATGGGATGTCACCTTGCATACTGGGGTGTTC |
| 963 | CGTWDVTLHIGVF | 1787 | TGCGGAACATGGGATGTCACCTTGCATATTGGGGTGTTC |
| 964 | CGTWDVTLHAGVF | 1788 | TGCGGAACATGGGATGTCACCTTGCATGCTGGGGTGTTC |
| 965 | CGTWDVSLYSGGVF | 1789 | TGCGGAACATGGGATGTCAGTTTGTATAGTGGCGGGGTCTTC |
| 966 | CGTWDVSLTSFVF | 1790 | TGTGGAACATGGGATGTCAGCCTGACTTCTTTCGTCTTC |
| 967 | CGTWDVSLSVGVL | 1791 | TGCGGAACATGGGATGTCAGCCTGAGTGTTGGGGTGCTC |
| 968 | CGTWDVSLSAGDVVF | 1792 | TGCGGAACGTGGGATGTCAGCCTGAGTGCTGGCGATGTAGTTTTC |
| 969 | CGTWDVSLNVVF | 1793 | TGCGGAACATGGGATGTCAGCCTGAATGTCGTGGTTTTC |
| 970 | CGTWDVSLNTQVF | 1794 | TGCGGAACATGGGATGTCAGCCTGAATACTCAGGTGTTC |
| 971 | CGTWDVSLGALF | 1795 | TGCGGCACATGGGATGTGAGCCTGGGTGCGCTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 972 | CGTWDVNLKTVVF | 1796 | TGCGGAACGTGGGACGTTAATCTGAAAACTGTCGTTTTC |
| 973 | CGTWDVILSAEVF | 1797 | TGCGGAACATGGGATGTCATCCTGAGTGCTGAGGTATTC |
| 974 | CGTWDTTVSAVVF | 1798 | TGCGGAACATGGGATACCACCGTGAGTGCTGTGGTTTTC |
| 975 | CGTWDTTLTAWVF | 1799 | TGCGGAACATGGGATACCACCCTGACTGCCTGGGTGTTC |
| 976 | CGTWDTTLSVFLF | 1800 | TGCGGAACATGGGACACCACCTTGAGTGTTTTCCTATTC |
| 977 | CGTWDTSVSAGVF | 1801 | TGCGGGACTTGGGATACCAGTGTGAGTGCTGGGGTGTTC |
| 978 | CGTWDTSVISWVF | 1802 | TGCGGAACATGGGATACCAGTGTGATTTCTTGGGTTTTC |
| 979 | CGTWDTSRSSLYVVF | 1803 | TGCGGAACATGGGATACCAGTCGGAGTTCTCTCTATGTGGTCTTC |
| 980 | CGTWDTSRSAWVF | 1804 | TGCGGAACATGGGATACCAGCCGGAGTGCTTGGGTATTC |
| 981 | CGTWDTSRNPGGIF | 1805 | TGCGGAACATGGGATACCAGCCGGAATCCTGGAGGAATTTTC |
| 982 | CGTWDTSRGHVF | 1806 | TGCGGAACATGGGACACCAGTCGGGGTCATGTTTTC |
| 983 | CGTWDTSPSTGQVLF | 1807 | TGCGGAACATGGGATACCAGCCCGAGTACTGGCCAGGTGCTTTTC |
| 984 | CGTWDTSPSAWVF | 1808 | TGCGGAACATGGGATACCAGCCCGAGTGCCTGGGTGTTC |
| 985 | CGTWDTSLTWVF | 1809 | TGCGGAACATGGGATACTAGCCTGACCTGGGTGTTC |
| 986 | CGTWDTSLTWFAVF | 1810 | TGCGGAACATGGGATACCAGCCTGACGTGGTTCGCAGTGTTC |
| 987 | CGTWDTSLTVVVF | 1811 | TGCGGAACATGGGATACCAGCCTGACTGTTGTGGTATTC |
| 988 | CGTWDTSLTTSWVF | 1812 | TGCGGAACATGGGATACCAGCCTGACTACTTCTTGGGTGTTC |
| 989 | CGTWDTSLTTGPFWVF | 1813 | TGCGGAACATGGGATACCAGCCTGACCACTGGTCCTTTTTGGGTGTTC |
| 990 | CGTWDTSLTPFYVF | 1814 | TGCGGAACATGGGATACCAGCCTGACTCCTTTTTATGTCTTC |
| 991 | CGTWDTSLTAYVF | 1815 | TGCGGAACATGGGATACCAGCCTGACTGCTTATGTCTTC |
| 992 | CGTWDTSLTAWVF | 1816 | TGCGGAACATGGGATACCAGCCTGACTGCTTGGGTGTTC |
| 993 | CGTWDTSLTAWGVF | 1817 | TGCGGAACATGGGATACCAGCCTGACTGCGTGGGGGGTGTTC |
| 994 | CGTWDTSLTAVVL | 1818 | TGCGGCACATGGGATACCAGCCTGACTGCGGTGGTTCTC |
| 995 | CGTWDTSLTARVF | 1819 | TGCGGAACCTGGGATACCAGCCTGACTGCTCGGGTTTTC |
| 996 | CGTWDTSLTAIVF | 1820 | TGCGGAACATGGGATACCAGCCTGACTGCGATTGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 997 | CGTWDTSLTAGVF | 1821 | TGCGGAACATGGGATACCAGCCTGACTGCTGGTGTCTTC |
| 998 | CGTWDTSLSVYVF | 1822 | TGCGGAACATGGGATACCAGCCTGAGTGTTTATGTCTTC |
| 999 | CGTWDTSLSVVF | 1823 | TGCGGGACATGGGATACCAGCCTGAGTGTGGTGTTC |
| 1000 | CGTWDTSLSVGEF | 1824 | TGCGGGACATGGGATACCAGCCTGAGTGTTGGGGAATTC |
| 1001 | CGTWDTSLSTWVF | 1825 | TGCGGAACATGGGATACCAGCCTGAGTACTTGGGTGTTC |
| 1002 | CGTWDTSLSTVVF | 1826 | TGCGGAACATGGGATACCAGCCTGAGTACTGTGGTATTC |
| 1003 | CGTWDTSLSTGQVLF | 1827 | TGCGGAACATGGGATACCAGCCTGAGTACTGGCCAGGTGCTTTTC |
| 1004 | CGTWDTSLSTGPLWVF | 1828 | TGCGGCACATGGGATACCAGCCTGAGCACTGGTCCTCTTTGGGTGTTC |
| 1005 | CGTWDTSLSSYVF | 1829 | TGCGGAACTTGGGATACCAGCCTGAGTTCTTATGTCTTC |
| 1006 | CGTWDTSLSSVVF | 1830 | TGCGGAACATGGGATACCAGCCTGAGTTCTGTGGTCTTC |
| 1007 | CGTWDTSLSSRYIF | 1831 | TGCGGAACATGGGATACCAGCCTGAGTTCTAGATACATATTC |
| 1008 | CGTWDTSLSSRFIF | 1832 | TGCGGAACATGGGATACCAGCCTGAGTTCTAGATTCATATTC |
| 1009 | CGTWDTSLSSGWVF | 1833 | TGCGGAACATGGGATACCAGCCTGAGTTCTGGGTGGGTGTTC |
| 1010 | CGTWDTSLSRYVF | 1834 | TGCGGAACATGGGATACCAGCCTGAGTCGGTATGTGTTC |
| 1011 | CGTWDTSLSQWLF | 1835 | TGCGGAACTTGGGATACCAGTCTGAGTCAATGGCTGTTC |
| 1012 | CGTWDTSLSPGLWVF | 1836 | TGCGGAACATGGGATACCAGCCTGAGTCCTGGCCTTTGGGTGTTC |
| 1013 | CGTWDTSLSNYVF | 1837 | TGCGGAACATGGGATACCAGCCTGAGTAATTATGTCTTC |
| 1014 | CGTWDTSLSIWVF | 1838 | TGCGGAACATGGGATACCAGCCTAAGTATTTGGGTGTTC |
| 1015 | CGTWDTSLSIGPFWVF | 1839 | TGCGGCACATGGGATACCAGCCTGAGCATTGGTCCTTTTTGGGTGTTC |
| 1016 | CGTWDTSLSGWVF | 1840 | TGCGGAACATGGGATACCAGCCTGAGTGGTTGGGTGTTC |
| 1017 | CGTWDTSLSGTVF | 1841 | TGCGGAACATGGGATACCAGCCTGAGTGGTACAGTGTTC |
| 1018 | CGTWDTSLSGGQVF | 1842 | TGCGGAACATGGGATACTAGTCTGAGTGGTGGCCAGGTGTTC |
| 1019 | CGTWDTSLSGGIF | 1843 | TGCGGAACATGGGATACCAGCCTGAGTGGTGGGATATTC |
| 1020 | CGTWDTSLSGEDVVI | 1844 | TGCGGAACATGGGATACCAGCCTGAGTGGTGAGGATGTGGTAATC |
| 1021 | CGTWDTSLSFLYAF | 1845 | TGCGGAACATGGGATACCAGCCTGAGTTTCCTTTATGCTTTC |

TABLE 13-continued

Sequences for IGLV1-51 CDR elements

| SEQ ID NO | Amino Acid Sequence | SEQ ID NO | Nucleotide Sequence |
|---|---|---|---|
| 1022 | CGTWDTSLSEVVF | 1846 | TGCGGAACATGGGATACCAGCCTGAGTGAGGTCGTATTC |
| 1023 | CGTWDTSLSEVF | 1847 | TGCGGAACATGGGATACCAGCCTGAGTGAAGTGTTC |
| 1024 | CGTWDTSLSENWVF | 1848 | TGCGGAACATGGGATACTAGCCTGAGTGAAAATTGGGTGTTC |
| 1025 | CGTWDTSLSAYIF | 1849 | TGCGGAACATGGGATACCAGCCTGAGTGCCTACATATTC |
| 1026 | CGTWDTSLSAVVL | 1850 | TGCGGAACATGGGATACCAGCCTGAGTGCTGTGGTACTC |
| 1027 | CGTWDTSLSAVF | 1851 | TGCGGAACATGGGATACCAGCCTGAGTGCTGTTTTC |
| 1028 | CGTWDTSLSARVF | 1852 | TGCGGAACATGGGATACCAGCCTGAGTGCCCGGGTGTTC |
| 1029 | CGTWDTSLSARQVF | 1853 | TGCGGCACATGGGATACCAGCCTGAGTGCCCGCCAGGTATTC |
| 1030 | CGTWDTSLSALVF | 1854 | TGCGGAACATGGGATACCAGCCTGAGTGCTTTGGTTTTC |
| 1031 | CGTWDTSLSAKVF | 1855 | TGCGGAACATGGGATACCAGCCTGAGTGCTAAGGTGTTC |
| 1032 | CGTWDTSLSAKIF | 1856 | TGCGGAACATGGGATACCAGCCTGAGTGCGAAAATCTTC |
| 1033 | CGTWDTSLSAKAVF | 1857 | TGCGGAACATGGGATACCAGCCTGAGTGCCAAGGCGGTATTC |
| 1034 | CGTWDTSLSAHAVF | 1858 | TGCGGAACATGGGATACCAGCCTGAGTGCCCATGCTGTGTTC |
| 1035 | CGTWDTSLSAGYVF | 1859 | TGCGGAACATGGGATACCAGCCTGAGTGCTGGCTATGTCTTC |
| 1036 | CGTWDTSLSAGRWVF | 1860 | TGCGGAACATGGGACACCAGTCTGAGTGCTGGCCGCTGGGTGTTC |
| 1037 | CGTWDTSLSAGIF | 1861 | TGCGGAACATGGGATACCAGCCTGAGTGCTGGGATATTC |
| 1038 | CGTWDTSLSAGGFRVF | 1862 | TGCGGAACATGGGATACCAGCCTGAGTGCTGGTGGGTTCCGGGTCTTC |
| 1039 | CGTWDTSLSAGAF | 1863 | TGCGGAACATGGGATACCAGCCTGAGTGCTGGGGCATTC |
| 1040 | CGTWDTSLSADWFF | 1864 | TGCGGAACATGGGATACCAGTCTGAGTGCTGATTGGTTTTTC |
| 1041 | CGTWDTSLSADEYVF | 1865 | TGCGGAACATGGGATACCAGCCTGAGTGCTGATGAATATGTCTTC |
| 1042 | CGTWDTSLSAAWVF | 1866 | TGCGGCACATGGGATACCAGCCTGAGTGCGGCTTGGGTGTTC |
| 1043 | CGTWDTSLSAALF | 1867 | TGCGGAACATGGGATACCAGCCTGAGTGCTGCGCTATTC |
| 1044 | CGTWDTSLSAAGVF | 1868 | TGCGGAACATGGGATACCAGCCTGAGTGCTGCGGGGGTTTTC |
| 1045 | CGTWDTSLRVVVF | 1869 | TGCGGAACATGGGATACCAGCCTGAGAGTTGTGGTTTTC |
| 1046 | CGTWDTSLRTWVF | 1870 | TGCGGAACATGGGATACCAGCCTGAGAACCTGGGTATTC |

TABLE 13-continued

Sequences for IGLV1-51 CDR elements

| SEQ ID NO | Amino Acid Sequence | SEQ ID NO | Nucleotide Sequence |
|---|---|---|---|
| 1047 | CGTWDTSLRGAVF | 1871 | TGCGGAACGTGGGATACCAGCCTGAGGGGTGCAGTGTTC |
| 1048 | CGTWDTSLRAVVF | 1872 | TGCGGAACATGGGATACCAGCCTGCGTGCTGTGGTATTC |
| 1049 | CGTWDTSLNVVYVF | 1873 | TGCGGAACATGGGATACAAGCCTGAATGTAGTTTATGTCTTC |
| 1050 | CGTWDTSLNTYLF | 1874 | TGCGGAACATGGGATACCAGCCTCAACACCTACCTGTTC |
| 1051 | CGTWDTSLNFAWLF | 1875 | TGCGGAACATGGGATACTAGCCTGAACTTCGCTTGGCTGTTC |
| 1052 | CGTWDTSLLVWLF | 1876 | TGCGGCACATGGGATACCAGCCTTCTTGTGTGGCTTTTC |
| 1053 | CGTWDTSLKTWVF | 1877 | TGCGGAACATGGGATACCAGTCTGAAGACGTGGGTGTTC |
| 1054 | CGTWDTSLIVWVF | 1878 | TGCGGAACATGGGATACCAGTCTGATTGTCTGGGTGTTC |
| 1055 | CGTWDTSLITGVF | 1879 | TGCGGAACATGGGATACCAGCCTAATTACTGGGGTGTTC |
| 1056 | CGTWDTSLISVVF | 1880 | TGCGGAACATGGGATACCAGCCTGATTAGCGTGGTATTC |
| 1057 | CGTWDTSLIAYVF | 1881 | TGCGGAACATGGGATACCAGCCTGATTGCTTATGTCTTC |
| 1058 | CGTWDTSLHTELF | 1882 | TGCGGAACATGGGATACCAGCCTGCACACTGAGTTGTTC |
| 1059 | CGTWDTSLGSYVF | 1883 | TGCGGAACTTGGGATACCAGCCTGGGTTCTTATGTCTTC |
| 1060 | CGTWDTSLGSLWVF | 1884 | TGCGGAACATGGGATACCAGCCTGGGTTCTCTTTGGGTGTTC |
| 1061 | CGTWDTSLGSGVF | 1885 | TGCGGTACATGGGATACCAGCCTGGGTTCTGGGGTATTC |
| 1062 | CGTWDTSLGGRGVF | 1886 | TGCGGAACTTGGGATACCAGTCTGGGTGGTAGAGGGGTCTTC |
| 1063 | CGTWDTSLGAWVF | 1887 | TGCGGAACATGGGATACCAGCCTGGGTGCTTGGGTGTTC |
| 1064 | CGTWDTSLGAVVF | 1888 | TGCGGAACATGGGATACCAGCCTGGGTGCCGTGGTATTC |
| 1065 | CGTWDTSLGAGVF | 1889 | TGCGGAACATGGGATACCAGCCTGGGTGCTGGGGTATTC |
| 1066 | CGTWDTSLGAGLF | 1890 | TGCGGAACATGGGATACCAGCCTGGGTGCTGGCCTATTC |
| 1067 | CGTWDTSLDAVVF | 1891 | TGCGGAACATGGGATACCAGTCTGGATGCTGTGGTTTTC |
| 1068 | CGTWDTSLDAVLF | 1892 | TGCGGGACTTGGGATACCAGCCTGGATGCTGTGCTGTTC |
| 1069 | CGTWDTSLAWVF | 1893 | TGCGGAACATGGGATACCAGCCTGGCTTGGGTGTTC |
| 1070 | CGTWDTSLATGLF | 1894 | TGCGGAACATGGGATACCAGCCTGGCGACTGGACTGTTC |
| 1071 | CGTWDTSLAPVVF | 1895 | TGCGGGACATGGGATACCAGCCTGGCCCCTGTAGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1072 | CGTWDTRLTIVIF | 1896 | TGCGGAACATGGGACACCCGCCTGACTATTGTGATCTTC |
| 1073 | CGTWDTRLSVWLF | 1897 | TGTGGAACATGGGACACCAGGCTGAGTGTTTGGCTGTTC |
| 1074 | CGTWDTRLSVGVF | 1898 | TGCGGAACGTGGGACACCAGACTGAGTGTTGGGGTTTTC |
| 1075 | CGTWDTRLSTVIF | 1899 | TGCGGCACATGGGATACCAGACTGAGTACTGTAATTTTC |
| 1076 | CGTWDTRLSSVVF | 1900 | TGCGGAACATGGGATACCCGCCTGAGTTCTGTGGTCTTC |
| 1077 | CGTWDTRLSIVVF | 1901 | TGCGGAACATGGGATACCCGCCTGAGTATTGTGGTTTTC |
| 1078 | CGTWDTRLSAYVVF | 1902 | TGCGGAACATGGGATACCAGACTGAGTGCCTATGTGGTATTC |
| 1079 | CGTWDTRLSAWVF | 1903 | TGCGGAACCTGGGACACCCGCCTGAGTGCGTGGGTGTTC |
| 1080 | CGTWDTRLSAVVF | 1904 | TGCGGAACATGGGATACCAGACTGAGTGCTGTGGTGTTC |
| 1081 | CGTWDTRLSAGLF | 1905 | TGCGGAACATGGGATACCCGCCTGAGTGCTGGGTTGTTC |
| 1082 | CGTWDTRLSAGGVF | 1906 | TGCGGAACATGGGATACCAGACTGAGTGCTGGTGGGGTGTTC |
| 1083 | CGTWDTRLNVWLF | 1907 | TGCGGAACATGGGATACCAGATTGAATGTGTGGCTATTC |
| 1084 | CGTWDTNREVVLL | 1908 | TGCGGAACATGGGATACCAACCGGGAAGTTGTGCTCCTC |
| 1085 | CGTWDTNLRAHVF | 1909 | TGCGGAACATGGGATACCAACCTGCGTGCCCATGTCTTC |
| 1086 | CGTWDTNLPAVVF | 1910 | TGCGGAACATGGGATACTAATCTGCCCGCTGTAGTGTTC |
| 1087 | CGTWDTNLGGVF | 1911 | TGCGGAACATGGGACACCAATTTGGGTGGGGTGTTC |
| 1088 | CGTWDTIVSIGVF | 1912 | TGCGGAACATGGGATACCATCGTGAGTATTGGGGTGTTC |
| 1089 | CGTWDTILSAVVF | 1913 | TGCGGAACATGGGATACCATCCTGAGTGCGGTGGTGTTC |
| 1090 | CGTWDTILSAEVF | 1914 | TGCGGCACATGGGATACCATCCTGAGTGCTGAGGTGTTC |
| 1091 | CGTWDTHLGVVF | 1915 | TGCGGAACATGGGATACCCACCTGGGTGTGGTTTTC |
| 1092 | CGTWDTGPSPHWLF | 1916 | TGCGGAACATGGGATACCGGCCCGAGCCCTCATTGGCTGTTC |
| 1093 | CGTWDTGLTFGGVF | 1917 | TGCGGAACATGGGATACCGGCCTGACTTTTGGAGGCGTGTTC |
| 1094 | CGTWDTGLTAFVF | 1918 | TGCGGAACATGGGATACCGGCCTGACTGCTTTTGTCTTC |
| 1095 | CGTWDTGLSVWVF | 1919 | TGCGGAACATGGGATACCGGCCTGAGTGTTTGGGTGTTC |
| 1096 | CGTWDTGLSTGIF | 1920 | TGCGGAACATGGGATACCGGCCTGAGTACTGGGATTTTC |

TABLE 13-continued

Sequences for IGLV1-51 CDR elements

| SEQ ID NO | Amino Acid Sequence | SEQ ID NO | Nucleotide Sequence |
|---|---|---|---|
| 1097 | CGTWDTGLSSLLF | 1921 | TGCGGAACATGGGATACCGGCCTGAGTTCCCTGCTCTTC |
| 1098 | CGTWDTGLSIVVF | 1922 | TGCGGAACGTGGGACACCGGCCTGAGTATTGTGGTGTTC |
| 1099 | CGTWDTGLSFVVF | 1923 | TGCGGAACGTGGGACACCGGCCTGAGTTTTGTGGTGTTC |
| 1100 | CGTWDTGLSAWVF | 1924 | TGCGGAACATGGGATACCGGCCTGAGTGCTTGGGTGTTC |
| 1101 | CGTWDTGLSAGVVF | 1925 | TGCGGAACATGGGATACCGGCCTGAGTGCTGGTGTGGTATTC |
| 1102 | CGTWDTGLRGWIF | 1926 | TGCGGAACATGGGATACCGGTCTGAGGGGTTGGATTTTC |
| 1103 | CGTWDTELSAGVF | 1927 | TGCGGAACATGGGATACCGAGCTAAGTGCGGGGGTCTTC |
| 1104 | CGTWDTALTAGVF | 1928 | TGCGGAACGTGGGATACCGCCCTGACTGCTGGGGTGTTC |
| 1105 | CGTWDTALSLVVF | 1929 | TGCGGAACATGGGATACTGCCCTGAGTCTTGTGGTCTTC |
| 1106 | CGTWDTALSAWLF | 1930 | TGCGGAACATGGGATACCGCCCTGAGTGCCTGGCTGTTC |
| 1107 | CGTWDTALSAGVF | 1931 | TGCGGCACATGGGATACCGCCCTGAGTGCTGGGGTGTTC |
| 1108 | CGTWDTALRGVLF | 1932 | TGCGGAACATGGGATACCGCCCTGCGTGGCGTGCTGTTC |
| 1109 | CGTWDTALKEWLF | 1933 | TGCGGAACATGGGATACCGCCCTGAAAGAATGGCTGTTC |
| 1110 | CGTWDRTLTAGDVLF | 1934 | TGCGGAACATGGGATAGGACCCTGACTGCTGGCGATGTGCTCTTC |
| 1111 | CGTWDRSVTYVF | 1935 | TGCGGAACATGGGATAGAAGCGTGACTTATGTCTTC |
| 1112 | CGTWDRSRNEWVF | 1936 | TGCGGAACATGGGATCGCAGCCGAAATGAATGGGTGTTC |
| 1113 | CGTWDRSLTVWVF | 1937 | TGCGGAACATGGGATCGCAGTCTGACTGTTTGGGTCTTC |
| 1114 | CGTWDRSLTPGWLF | 1938 | TGCGGAACATGGGATCGCAGCCTGACTCCTGGGTGGTTGTTC |
| 1115 | CGTWDRSLTAWVF | 1939 | TGCGGAACATGGGATAGAAGCCTGACTGCTTGGGTGTTC |
| 1116 | CGTWDRSLSVVVF | 1940 | TGCGGAACATGGGACCGCAGCCTGAGTGTTGTGGTATTC |
| 1117 | CGTWDRSLSVVF | 1941 | TGCGGCACATGGGATCGCAGCCTGAGTGTAGTCTTC |
| 1118 | CGTWDRSLSVQLF | 1942 | TGCGGAACATGGGATAGGAGCCTGAGTGTTCAATTGTTC |
| 1119 | CGTWDRSLSVLWVF | 1943 | TGCGGAACATGGGATCGCAGCCTCAGTGTTCTTTGGGTGTTC |
| 1120 | CGTWDRSLSVGLF | 1944 | TGCGGAACATGGGATCGCAGCCTGAGTGTTGGATTATTC |
| 1121 | CGTWDRSLSTWVF | 1945 | TGCGGAACATGGGATCGCAGCCTGAGTACTTGGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1122 | CGTWDRSLSTHWVL | 1946 | TGCGGAACATGGGATAGAAGCCTGAGTACTCATTGGGTGCTC |
| 1123 | CGTWDRSLSTHWVF | 1947 | TGCGGAACATGGGATAGAAGCCTGAGTACTCATTGGGTGTTC |
| 1124 | CGTWDRSLSSAVF | 1948 | TGCGGAACCTGGGATCGAAGCCTGAGTTCTGCGGTGTTC |
| 1125 | CGTWDRSLSPSYVF | 1949 | TGCGGAACATGGGACAGAAGCCTGAGTCCCTCTTATGTCTTC |
| 1126 | CGTWDRSLSGEVF | 1950 | TGCGGAACATGGGATAGGAGCCTGAGTGGTGAGGTGTTC |
| 1127 | CGTWDRSLSGAVF | 1951 | TGCGGAACATGGGATAGGAGCCTGAGTGGTGCGGTGTTC |
| 1128 | CGTWDRSLSAVAF | 1952 | TGCGGAACATGGGATCGCAGCCTGAGTGCTGTGGCATTC |
| 1129 | CGTWDRSLSAGGEF | 1953 | TGCGGAACATGGGATAGGAGCCTGAGTGCCGGGGGGGAATTC |
| 1130 | CGTWDRSLSAFWVF | 1954 | TGCGGAACATGGGATCGCAGCCTGAGTGCTTTTTGGGTGTTC |
| 1131 | CGTWDRSLSAAVF | 1955 | TGCGGAACATGGGATAGGAGCCTGAGTGCTGCGGTGTTC |
| 1132 | CGTWDRSLSAALF | 1956 | TGCGGAACATGGGATAGGAGCCTGAGTGCTGCACTCTTC |
| 1133 | CGTWDRSLRVF | 1957 | TGCGGAACATGGGATCGCAGCCTGAGAGTGTTC |
| 1134 | CGTWDRSLNWVF | 1958 | TGCGGTACATGGGACAGAAGCCTTAATTGGGTGTTC |
| 1135 | CGTWDRSLNVYVF | 1959 | TGCGGAACATGGGATCGCAGCCTGAATGTTTATGTCTTC |
| 1136 | CGTWDRSLNVGVF | 1960 | TGCGGAACATGGGATAGGAGCCTGAATGTTGGGGTGTTC |
| 1137 | CGTWDRSLHVVF | 1961 | TGCGGAACATGGGATCGGAGCCTGCATGTGGTCTTC |
| 1138 | CGTWDRSLGGWVF | 1962 | TGTGGAACATGGGATCGCAGCCTGGGTGGTTGGGTGTTC |
| 1139 | CGTWDRSLGAFWVF | 1963 | TGCGGAACATGGGATCGCAGCCTGGGTGCTTTTTGGGTGTTC |
| 1140 | CGTWDRSLFWVF | 1964 | TGCGGAACATGGGATAGAAGCCTGTTTTGGGTGTTC |
| 1141 | CGTWDRSLAAGVF | 1965 | TGCGGAACGTGGGATCGCAGCCTGGCTGCTGGGGTGTTC |
| 1142 | CGTWDRRLSGVVF | 1966 | TGCGGAACATGGGATAGGAGGTTGAGTGGTGTCGTATTC |
| 1143 | CGTWDRRLSDVVF | 1967 | TGCGGAACGTGGGATCGCCGCCTAAGTGATGTGGTATTC |
| 1144 | CGTWDRRLSAVVF | 1968 | TGCGGAACATGGGATAGGAGGCTGAGTGCTGTGGTATTC |
| 1145 | CGTWDRRLNVAFF | 1969 | TGCGGAACATGGGATAGACGCCTGAATGTTGCGTTCTTC |
| 1146 | CGTWDRRLLAVF | 1970 | TGTGGAACATGGGATAGGAGGCTGCTTGCTGTTTTC |

TABLE 13-continued

Sequences for IGLV1-51 CDR elements

| SEQ ID NO | Amino Acid Sequence | SEQ ID NO | Nucleotide Sequence |
|---|---|---|---|
| 1147 | CGTWDRNLRAVVF | 1971 | TGCGGAACTTGGGATAGGAACCTGCGCGCCGTGGTCTTC |
| 1148 | CGTWDRLSAGVF | 1972 | TGCGGAACATGGGATAGGCTGAGTGCTGGGGTGTTC |
| 1149 | CGTWDRGPNTGVF | 1973 | TGCGGAACATGGGATAGAGGCCCGAATACTGGGGTATTC |
| 1150 | CGTWDRGLNTVYVF | 1974 | TGCGGAACATGGGATAGAGGCCTGAATACTGTTTACGTCTTC |
| 1151 | CGTWDNYVSAPWVF | 1975 | TGCGGAACATGGGATAACTATGTGAGTGCCCCTTGGGTGTTC |
| 1152 | CGTWDNYLSAGDVVF | 1976 | TGCGGAACATGGGATAACTACCTGAGTGCTGGCGATGTGGTTTTC |
| 1153 | CGTWDNYLRAGVF | 1977 | TGCGGAACATGGGATAACTACCTGAGAGCTGGGGTCTTC |
| 1154 | CGTWDNYLGAVVF | 1978 | TGCGGAACATGGGACAATTATCTGGGTGCCGTGGTTTTC |
| 1155 | CGTWDNYLGAGVF | 1979 | TGCGGAACATGGGATAACTACCTGGGTGCGGGGGTGTTC |
| 1156 | CGTWDNTVSAPWVF | 1980 | TGCGGAACATGGGATAACACCGTGAGTGCCCCTTGGGTTTTC |
| 1157 | CGTWDNTLSLWVF | 1981 | TGCGGAACATGGGATAACACCCTGAGTCTTTGGGTGTTC |
| 1158 | CGTWDNTLSAGVF | 1982 | TGCGGAACATGGGATAACACCCTGAGTGCTGGGGTCTTC |
| 1159 | CGTWDNTLLTVLF | 1983 | TGCGGAACATGGGACAACACTCTGCTTACTGTGTTATTC |
| 1160 | CGTWDNRLSSVIF | 1984 | TGCGGAACATGGGATAACAGACTGAGTAGTGTGATTTTC |
| 1161 | CGTWDNRLSAVVF | 1985 | TGCGGAACATGGGATAACAGGTTGAGTGCTGTGGTCTTC |
| 1162 | CGTWDNRLSAGGIF | 1986 | TGCGGAACATGGGATAACAGGCTGAGTGCTGGTGGGATATTC |
| 1163 | CGTWDNRLSAEVF | 1987 | TGCGGAACATGGGATAACAGACTGAGTGCTGAGGTGTTC |
| 1164 | CGTWDNRLRVGVL | 1988 | TGTGGAACATGGGATAACAGACTGCGTGTTGGGGTTCTC |
| 1165 | CGTWDNRLLENVF | 1989 | TGCGGAACATGGGATAATCGCCTGCTTGAGAATGTCTTC |
| 1166 | CGTWDNNLRAVF | 1990 | TGCGGAACATGGGATAACAACCTGCGTGCTGTCTTC |
| 1167 | CGTWDNNLRAGVF | 1991 | TGCGGAACTTGGGATAATAACCTGCGTGCTGGAGTGTTC |
| 1168 | CGTWDNNLGGGRVF | 1992 | TGCGGAACATGGGACAACAATTTGGGCGGTGGCCGGGTGTTC |
| 1169 | CGTWDNNLGAGVL | 1993 | TGCGGAACATGGGATAACAACCTGGGTGCTGGCGTCCTC |
| 1170 | CGTWDNNLGAGVF | 1994 | TGCGGAACATGGGATAACAACCTGGGTGCTGGCGTCTTC |
| 1171 | CGTWDNILSAAVF | 1995 | TGCGGAACTTGGGATAACATCCTGAGCGCTGCGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1172 | CGTWDNILDAGVF | 1996 | TGCGGAACCTGGGATAACATCTTGGATGCAGGGGTTTTC |
| 1173 | CGTWDNDLSGWLF | 1997 | TGCGGAACATGGGATAACGACCTGAGTGGTTGGCTGTTC |
| 1174 | CGTWDNDLSAWVF | 1998 | TGCGGAACATGGGATAACGACCTGAGTGCCTGGGTGTTC |
| 1175 | CGTWDLTLGGVVF | 1999 | TGCGGAACATGGGATCTCACCCTGGGTGGTGTGGTGTTC |
| 1176 | CGTWDLSLSAGVF | 2000 | TGCGGAACATGGGATCTCAGCCTGAGTGCTGGGGTATTC |
| 1177 | CGTWDLSLKEWVF | 2001 | TGCGGAACATGGGATCTCAGCCTGAAAGAATGGGTGTTC |
| 1178 | CGTWDLSLDAVVF | 2002 | TGCGGAACGTGGGATCTCAGCCTGGATGCTGTTGTTTTC |
| 1179 | CGTWDLKVF | 2003 | TGCGGAACCTGGGACCTGAAGGTTTTC |
| 1180 | CGTWDKTLSVWVF | 2004 | TGCGGAACATGGGATAAGACTCTGAGTGTTTGGGTGTTC |
| 1181 | CGTWDKSLSVWVF | 2005 | TGCGGAACATGGGATAAGAGCCTGAGTGTTTGGGTGTTC |
| 1182 | CGTWDKSLSGVVF | 2006 | TGCGGAACATGGGATAAGAGCCTGAGTGGTGTGGTATTT |
| 1183 | CGTWDKSLSDWVF | 2007 | TGCGGAACATGGGATAAGAGCCTGAGTGATTGGGTGTTC |
| 1184 | CGTWDKSLSALVF | 2008 | TGCGGAACATGGGATAAGAGCCTGAGTGCTTTGGTTTTC |
| 1185 | CGTWDKSLSAGVF | 2009 | TGCGGAACATGGGATAAGAGCCTGAGTGCTGGCGTCTTC |
| 1186 | CGTWDKSLSADVF | 2010 | TGCGGAACATGGGATAAGAGCCTGAGTGCCGACGTCTTC |
| 1187 | CGTWDKRLTIVVF | 2011 | TGCGGAACATGGGATAAACGCCTGACTATTGTGGTCTTC |
| 1188 | CGTWDKRLSAWVL | 2012 | TGCGGAACATGGGATAAACGCCTGAGTGCCTGGGTGCTC |
| 1189 | CGTWDKNLRAVVF | 2013 | TGCGGAACATGGGATAAGAACCTGCGTGCTGTGGTCTTC |
| 1190 | CGTWDITLSGFVF | 2014 | TGCGGAACATGGGATATCACCCTGAGTGGGTTTGTCTTC |
| 1191 | CGTWDITLHTGVF | 2015 | TGCGGAACATGGGATATCACCTTGCATACTGGAGTATTC |
| 1192 | CGTWDISVTVVF | 2016 | TGCGGAACATGGGATATCAGTGTGACTGTGGTGTTC |
| 1193 | CGTWDISVRGYAF | 2017 | TGCGGAACATGGGATATCAGTGTGAGGGGTTATGCCTTC |
| 1194 | CGTWDISRWVF | 2018 | TGCGGAACATGGGATATCAGCCGTTGGGTTTTC |
| 1195 | CGTWDISPSAWVF | 2019 | TGCGGAACATGGGATATCAGCCCGAGTGCTTGGGTGTTC |
| 1196 | CGTWDISLSVWVF | 2020 | TGCGGAACATGGGATATTAGCCTGAGTGTCTGGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1197 | CGTWDISLSVVF | 2021 | TGCGGAACATGGGATATCAGCCTGAGTGTTGTATTC |
| 1198 | CGTWDISLSSVVF | 2022 | TGCGGAACTTGGGATATCAGCCTGAGTTCTGTGGTGTTC |
| 1199 | CGTWDISLSHWLF | 2023 | TGCGGAACATGGGATATCAGCCTGAGTCACTGGTTGTTC |
| 1200 | CGTWDISLSGWVF | 2024 | TGCGGAACATGGGATATCAGTCTGAGTGGTTGGGTGTTC |
| 1201 | CGTWDISLSGRVF | 2025 | TGCGGAACATGGGATATCAGCCTGAGTGGTCGAGTGTTC |
| 1202 | CGTWDISLSAWAF | 2026 | TGCGGAACATGGGACATCAGCCTGAGTGCTTGGGCGTTC |
| 1203 | CGTWDISLSAVVF | 2027 | TGCGGAACATGGGATATCAGCCTGAGTGCTGTGGTTTTC |
| 1204 | CGTWDISLSAVIF | 2028 | TGCGGGACATGGGACATCAGCCTGAGTGCTGTGATATTC |
| 1205 | CGTWDISLSAVF | 2029 | TGCGGAACATGGGATATCAGCCTGAGTGCTGTGTTC |
| 1206 | CGTWDISLSARVF | 2030 | TGCGGAACATGGGATATCAGCCTGAGTGCCCGGGTGTTC |
| 1207 | CGTWDISLSALVF | 2031 | TGCGGAACATGGGATATCAGCCTGAGTGCCCTGGTGTTC |
| 1208 | CGTWDISLSAHVF | 2032 | TGCGGAACATGGGATATTAGCCTGAGTGCCCATGTCTTC |
| 1209 | CGTWDISLSAGVVF | 2033 | TGCGGAACATGGGATATCAGCCTGAGTGCTGGGGTGGTATTC |
| 1210 | CGTWDISLSAGPYVF | 2034 | TGCGGAACATGGGATATCAGCCTGAGTGCCGGCCCTTATGTCTTC |
| 1211 | CGTWDISLSAGGVF | 2035 | TGCGGCACATGGGATATCAGCCTGAGTGCTGGAGGGGTGTTC |
| 1212 | CGTWDISLSAEVF | 2036 | TGCGGAACATGGGATATCAGCCTGAGTGCTGAGGTTTTC |
| 1213 | CGTWDISLSAAVF | 2037 | TGCGGAACATGGGATATCAGCCTGAGTGCTGCTGTGTTC |
| 1214 | CGTWDISLRAVF | 2038 | TGCGGAACATGGGATATCAGCCTGCGTGCTGTGTTC |
| 1215 | CGTWDISLNTGVF | 2039 | TGCGGAACATGGGATATTAGCCTGAATACTGGGGTGTTC |
| 1216 | CGTWDISLNNYVF | 2040 | TGCGGAACATGGGATATCAGCCTAAATAATTATGTCTTC |
| 1217 | CGTWDISLIAGVF | 2041 | TGCGGAACATGGGATATCAGCCTAATTGCTGGGGTATTC |
| 1218 | CGTWDISLHTWLF | 2042 | TGCGGAACATGGGATATCAGCCTGCATACTTGGCTGTTC |
| 1219 | CGTWDIRLTDELLF | 2043 | TGCGGAACATGGGATATCCGCCTGACCGATGAGCTGTTATTC |
| 1220 | CGTWDIRLSGFVF | 2044 | TGCGGAACATGGGATATCAGACTGAGCGGTTTTGTTTTC |
| 1221 | CGTWDINLGAGGLYVF | 2045 | TGCGGAACATGGGATATCAACCTGGGTGCTGGGGGCCTTTATGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1222 | CGTWDIILSAEVF | 2046 | TGCGGAACATGGGATATCATCCTGAGTGCTGAGGTATTC |
| 1223 | CGTWDHTLSAVF | 2047 | TGCGGAACATGGGATCACACCCTGAGTGCTGTCTTC |
| 1224 | CGTWDHTLLTVLF | 2048 | TGCGGAACATGGGACCACACTCTGCTTACTGTGTTATTC |
| 1225 | CGTWDHSLTAVVF | 2049 | TGCGGAACATGGGATCACAGCCTGACTGCTGTGGTATTC |
| 1226 | CGTWDHSLTAGIF | 2050 | TGCGGAACCTGGGATCACAGCCTGACTGCTGGGATATTC |
| 1227 | CGTWDHSLSVVLF | 2051 | TGCGGAACATGGGATCACAGCCTGAGTGTTGTATTATTC |
| 1228 | CGTWDHSLSLVF | 2052 | TGCGGAACATGGGATCACAGCCTGAGTTTGGTATTC |
| 1229 | CGTWDHSLSIGVF | 2053 | TGCGGAACATGGGATCACAGCCTGTCTATTGGGGTTTTC |
| 1230 | CGTWDHSLSAGVF | 2054 | TGCGGAACATGGGATCACAGCCTGAGTGCTGGGGTGTTC |
| 1231 | CGTWDHSLSAFVF | 2055 | TGTGGAACTTGGGATCACAGCCTGAGTGCTTTCGTGTTC |
| 1232 | CGTWDHSLSAAVF | 2056 | TGCGGAACATGGGATCACAGTCTGAGTGCTGCTGTTTTC |
| 1233 | CGTWDHNLRAVF | 2057 | TGCGGAACATGGGACCACAATCTGCGTGCTGTCTTC |
| 1234 | CGTWDFTLSVGRF | 2058 | TGCGGGACATGGGATTTCACCCTGAGTGTTGGGCGCTTC |
| 1235 | CGTWDFTLSAPVF | 2059 | TGCGGAACATGGGATTTCACCCTGAGTGCTCCTGTCTTC |
| 1236 | CGTWDFSVSAGWVF | 2060 | TGCGGAACGTGGGATTTCAGCGTGAGTGCTGGGTGGGTGTTC |
| 1237 | CGTWDFSLTTWLF | 2061 | TGCGGAACGTGGGATTTCAGTCTTACTACCTGGTTATTC |
| 1238 | CGTWDFSLSVWVF | 2062 | TGCGGAACATGGGATTTCAGCCTGAGTGTTTGGGTGTTC |
| 1239 | CGTWDFSLSTGVF | 2063 | TGCGGAACATGGGATTTCAGCCTGAGTACTGGGGTTTTC |
| 1240 | CGTWDFSLSGVVF | 2064 | TGCGGCACATGGGATTTCAGCCTGAGTGGTGTGGTATTC |
| 1241 | CGTWDFSLSGFVF | 2065 | TGCGGAACATGGGATTTCAGCCTGAGTGGTTTCGTGTTC |
| 1242 | CGTWDFSLSAGVF | 2066 | TGCGGAACATGGGATTTCAGCCTGAGTGCTGGGGTGTTC |
| 1243 | CGTWDETVRGWVF | 2067 | TGCGGAACATGGGATGAAACCGTGAGAGGTTGGGTGTTC |
| 1244 | CGTWDESLRSWVF | 2068 | TGCGGAACATGGGATGAAAGTCTGAGAAGCTGGGTGTTC |
| 1245 | CGTWDERQTDESYVF | 2069 | TGCGGAACTTGGGATGAGAGGCAGACTGATGAGTCCTATGTCTTC |
| 1246 | CGTWDERLVAGQVF | 2070 | TGCGGAACATGGGATGAGAGACTCGTTGCTGGCCAGGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1247 | CGTWDERLSPGAFF | 2071 | TGCGGAACATGGGATGAGAGACTGAGTCCTGGAGCTTTTTC |
| 1248 | CGTWDEKVF | 2072 | TGCGGAACATGGGATGAGAAGGTGTTC |
| 1249 | CGTWDEGQTTDFFVF | 2073 | TGCGGAACCTGGGATGAAGGCCAGACTACTGATTTCTTTGTCTTC |
| 1250 | CGTWDDTLAGVVF | 2074 | TGCGGAACATGGGATGACACCCTGGCTGGTGTGGTCTTC |
| 1251 | CGTWDDRLTSAVF | 2075 | TGCGGAACATGGGATGACAGGCTGACTTCTGCGGTCTTC |
| 1252 | CGTWDDRLFVVVF | 2076 | TGCGGAACATGGGATGACAGACTGTTTGTTGTGGTATTC |
| 1253 | CGTWDDNLRGWVF | 2077 | TGCGGAACATGGGATGATAACCTGAGAGGTTGGGTGTTC |
| 1254 | CGTWDDNLRGVVF | 2078 | TGCGGAACATGGGATGACAACCTGCGTGGTGTCGTGTTC |
| 1255 | CGTWDDNLNIGRVF | 2079 | TGCGGAACCTGGGATGACAATTTGAATATTGGAAGGGTGTTC |
| 1256 | CGTWDDILSAVIF | 2080 | TGCGGAACATGGGATGACATCCTGAGTGCTGTGATATTC |
| 1257 | CGTWDDILRGWVF | 2081 | TGCGGAACATGGGATGATATCCTGAGAGGTTGGGTGTTC |
| 1258 | CGTWDATLSPGWLF | 2082 | TGCGGAACATGGGATGCCACCCTGAGTCCTGGGTGGTTATTC |
| 1259 | CGTWDASVTSWVF | 2083 | TGCGGAACATGGGATGCCAGCGTGACTTCTTGGGTGTTC |
| 1260 | CGTWDASLTSVVF | 2084 | TGCGGAACATGGGATGCCAGCCTGACTTCTGTGGTCTTC |
| 1261 | CGTWDASLSVWVF | 2085 | TGCGGAACATGGGATGCCAGCCTGAGTGTTTGGGTGTTC |
| 1262 | CGTWDASLSVPWVF | 2086 | TGCGGAACATGGGATGCCAGCCTGAGTGTTCCTTGGGTGTTC |
| 1263 | CGTWDASLSVAVF | 2087 | TGCGGAACATGGGATGCCAGCCTGAGTGTGGCGGTATTC |
| 1264 | CGTWDASLSTWVF | 2088 | TGCGGAACATGGGATGCCAGCCTGAGTACCTGGGTATTC |
| 1265 | CGTWDASLSGVVF | 2089 | TGCGGAACATGGGATGCCAGCCTGAGTGGTGTGGTATTC |
| 1266 | CGTWDASLSGGGEF | 2090 | TGCGGAACATGGGATGCCAGCCTGAGTGGTGGGGGAGAATTC |
| 1267 | CGTWDASLSAGVF | 2091 | TGCGGAACATGGGATGCCAGCCTGAGTGCTGGGGTGTTC |
| 1268 | CGTWDASLSAGLF | 2092 | TGCGGAACATGGGATGCCAGCCTGAGTGCTGGGCTTTTC |
| 1269 | CGTWDASLSAEVF | 2093 | TGTGGCACATGGGATGCCAGCCTGAGTGCTGAAGTCTTC |
| 1270 | CGTWDASLSADFWVF | 2094 | TGCGGAACATGGGATGCCAGCCTGAGTGCTGACTTTTGGGTGTTC |
| 1271 | CGTWDASLRVFF | 2095 | TGCGGAACATGGGATGCCAGCCTGAGAGTCTTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1272 | CGTWDASLRAVVL | 2096 | TGCGGAACATGGGATGCCAGTCTGAGGGCTGTGGTACTC |
| 1273 | CGTWDASLNIWVF | 2097 | TGCGGAACATGGGATGCCAGCCTGAATATTTGGGTTTTC |
| 1274 | CGTWDASLKNLVF | 2098 | TGCGGGACATGGGATGCCAGCCTGAAGAATCTGGTCTTC |
| 1275 | CGTWDASLGAWVF | 2099 | TGCGGAACATGGGATGCCAGCCTGGGTGCCTGGGTATTC |
| 1276 | CGTWDASLGAVVF | 2100 | TGCGGAACATGGGATGCCAGCCTGGGTGCTGTGGTCTTC |
| 1277 | CGTWDASLGAGVF | 2101 | TGCGGAACATGGGATGCCAGCCTGGGTGCGGGGTCTTC |
| 1278 | CGTWDARLSGLYVF | 2102 | TGCGGAACATGGGATGCTAGGCTGAGTGGCCTTTATGTCTTC |
| 1279 | CGTWDARLGGAVF | 2103 | TGTGGAACCTGGGATGCGAGACTGGGTGGTGCAGTCTTC |
| 1280 | CGTWDANLRAGVF | 2104 | TGCGGAACATGGGATGCCAATCTGCGTGCTGGGGTCTTC |
| 1281 | CGTWDAIISGWVF | 2105 | TGCGGAACATGGGATGCTATCATAAGTGGTTGGGTGTTC |
| 1282 | CGTWDAGQSVWVF | 2106 | TGCGGAACATGGGATGCCGGCCAGAGTGTTTGGGTGTTC |
| 1283 | CGTWDAGLTGLYVF | 2107 | TGCGGCACATGGGATGCCGGGCTGACTGGCCTTTATGTCTTC |
| 1284 | CGTWDAGLSVYVF | 2108 | TGCGGAACTTGGGATGCCGGTCTGAGTGTTTATGTCTTC |
| 1285 | CGTWDAGLSTGVF | 2109 | TGCGGGACATGGGATGCCGGCCTGAGTACTGGGGTCTTC |
| 1286 | CGTWDAGLSGDVF | 2110 | TGCGGAACATGGGATGCCGGCCTGAGTGGGGACGTTTTC |
| 1287 | CGTWDAGLSAGYVF | 2111 | TGCGGAACATGGGATGCCGGCCTGAGTGCTGGTTATGTCTTC |
| 1288 | CGTWDAGLRVWVF | 2112 | TGCGGAACATGGGATGCCGGCCTGCGTGTTTGGGTGTTC |
| 1289 | CGTWDAGLREIF | 2113 | TGCGGAACATGGGATGCCGGCCTGAGGGAAATTTTC |
| 1290 | CGTWASSLSSWVF | 2114 | TGCGGAACATGGGCCAGCAGCCTGAGTTCTTGGGTGTTC |
| 1291 | CGTWAGSLSGHVF | 2115 | TGCGGAACATGGGCTGGCAGCCTGAGTGGTCATGTCTTC |
| 1292 | CGTWAGSLSAAWVF | 2116 | TGCGGAACATGGGCTGGCAGCCTGAGTGCCGCTTGGGTGTTC |
| 1293 | CGTWAGSLNVYWVF | 2117 | TGCGGAACATGGGCTGGCAGCCTGAATGTTTATTGGGTGTTC |
| 1294 | CGTWAGNLRPNWVF | 2118 | TGCGGAACATGGGCTGGCAACCTGAGACCTAATTGGGTGTTC |
| 1295 | CGTRGSLGGAVF | 2119 | TGCGGAACAAGGGGTAGCCTGGGTGGTGCGGTGTTC |
| 1296 | CGTRDTTLSVPVF | 2120 | TGCGGAACAAGGGATACCACCCTGAGTGTCCCGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1297 | CGTRDTSLNIEIF | 2121 | TGCGGAACACGGGATACCAGCCTCAATATTGAAATCTTC |
| 1298 | CGTRDTSLNDVF | 2122 | TGTGGAACACGGGATACCAGCCTGAATGATGTCTTC |
| 1299 | CGTRDTRLSIVVF | 2123 | TGCGGAACACGGGATACCCGCCTGAGTATTGTGGTTTTC |
| 1300 | CGTRDTILSAEVF | 2124 | TGCGGCACACGGGATACCATCCTGAGTGCTGAGGTGTTC |
| 1301 | CGTRDRSLSGWVF | 2125 | TGCGGAACACGGGATAGAAGCCTGAGTGGTTGGGTGTTC |
| 1302 | CGSWYYNVFLF | 2126 | TGCGGATCATGGTATTACAATGTCTTCCTTTTC |
| 1303 | CGSWHSSLNLVVF | 2127 | TGCGGATCTTGGCATAGCAGCCTCAACCTTGTCGTCTTC |
| 1304 | CGSWGSGLSAPYVF | 2128 | TGCGGATCATGGGGTAGTGGCCTGAGTGCCCCTTATGTCTTC |
| 1305 | CGSWESGLGAWLF | 2129 | TGCGGTTCGTGGGAAAGCGGCCTGGGTGCTTGGCTGTTC |
| 1306 | CGSWDYGLLLF | 2130 | TGCGGATCCTGGGATTACGGCCTCCTACTCTTC |
| 1307 | CGSWDVSLTAVF | 2131 | TGCGGTTCATGGGATGTCAGCCTGACTGCTGTTTTC |
| 1308 | CGSWDVSLNVGIF | 2132 | TGCGGATCCTGGGATGTCAGTCTCAATGTTGGCATTTC |
| 1309 | CGSWDTTLRAWVF | 2133 | TGCGGATCATGGGATACCACCCTGCGTGCTTGGGTGTTC |
| 1310 | CGSWDTSPVRAWVF | 2134 | TGCGGCTCGTGGGATACCAGCCCTGTCCGTGCTTGGGTGTTC |
| 1311 | CGSWDTSLSVWVF | 2135 | TGCGGATCATGGGATACCAGCCTGAGTGTTTGGGTGTTC |
| 1312 | CGSWDTSLSAEVF | 2136 | TGCGGATCATGGGATACCAGCCTGAGTGCTGAGGTGTTC |
| 1313 | CGSWDTSLRAWVF | 2137 | TGCGGCTCGTGGGATACCAGCCTGCGTGCTTGGGTGTTC |
| 1314 | CGSWDTSLRAWAF | 2138 | TGCGGCTCGTGGGATACCAGCCTGCGTGCTTGGGCGTTC |
| 1315 | CGSWDTSLDARLF | 2139 | TGCGGATCATGGGATACCAGCCTGGATGCTAGGCTGTTC |
| 1316 | CGSWDTILLVYVF | 2140 | TGCGGATCATGGGATACCATCCTGCTTGTCTATGTCTTC |
| 1317 | CGSWDRWQAAVF | 2141 | TGCGGATCATGGGATCGCTGGCAGGCTGCTGTCTTC |
| 1318 | CGSWDRSLSGYVF | 2142 | TGCGGATCATGGGATAGGAGCCTGAGTGGGTATGTCTTC |
| 1319 | CGSWDRSLSAYVF | 2143 | TGCGGATCATGGGATAGAAGCCTGAGTGCTTATGTCTTC |
| 1320 | CGSWDRSLSAVVF | 2144 | TGCGGATCATGGGATAGGAGCCTGAGTGCCGTGGTTTTC |
| 1321 | CGSWDNTLGVVLF | 2145 | TGCGGATCATGGGATAACACCTTGGGTGTTGTTCTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1322 | CGSWDNRLSTVIF | 2146 | TGCGGATCGTGGGATAACAGACTAAGTACTGTCATCTTC |
| 1323 | CGSWDNRLNTVIF | 2147 | TGCGGAAGCTGGGATAATCGATTGAACACTGTGATTTTC |
| 1324 | CGSWDLSPVRVLVF | 2148 | TGCGGTTCATGGGATCTCAGCCCTGTACGTGTCCTTGTGTTC |
| 1325 | CGSWDLSLSAVVF | 2149 | TGCGGATCATGGGATCTCAGCCTGAGTGCTGTCGTTTTC |
| 1326 | CGSWDKNLRAVLF | 2150 | TGCGGATCATGGGATAAAAACCTGCGTGCTGTGCTGTTC |
| 1327 | CGSWDISLSAGVF | 2151 | TGCGGCTCATGGGATATCAGCCTGAGTGCTGGGGTGTTC |
| 1328 | CGSWDIRLSAEVF | 2152 | TGCGGATCATGGGATATCAGACTGAGTGCAGAGGTCTTC |
| 1329 | CGSWDIKLNIGVF | 2153 | TGCGGATCATGGGACATCAAACTGAATATTGGGGTATTC |
| 1330 | CGSWDFSLNYFVF | 2154 | TGCGGATCATGGGATTTCAGTCTCAATTATTTTGTCTTC |
| 1331 | CGSWDASLSTEVF | 2155 | TGCGGATCATGGGATGCCAGCCTGAGTACTGAGGTGTTC |
| 1332 | CGSWDAGLRGWVF | 2156 | TGCGGATCCTGGGATGCCGGCCTGCGTGGCTGGGTTTTC |
| 1333 | CGRWESSLGAVVF | 2157 | TGCGGAAGATGGGAGAGCAGCCTGGGTGCTGTGGTTTTC |
| 1334 | CGRWDFSLSAYVF | 2158 | TGCGGAAGATGGGATTTTAGTCTGAGTGCTTATGTCTTC |
| 1335 | CGQWDNDLSVWVF | 2159 | TGCGGACAATGGGATAACGACCTGAGTGTTTGGGTGTTC |
| 1336 | CGPWHSSVTSGHVL | 2160 | TGCGGACCCTGGCATAGCAGCGTGACTAGTGGCCACGTGCTC |
| 1337 | CGLWDASLSAPTWVF | 2161 | TGCGGATTATGGGATGCCAGCCTGAGTGCTCCTACTTGGGTGTTC |
| 1338 | CGIWHTSLSAWVF | 2162 | TGTGGAATATGGCACACTAGCCTGAGTGCTTGGGTGTTC |
| 1339 | CGIWDYSLDTWVF | 2163 | TGCGGAATATGGGATTACAGCCTGGATACTTGGGTGTTC |
| 1340 | CGIWDTSLSAWVF | 2164 | TGCGGCATATGGGATACCAGCCTGAGTGCTTGGGTGTTC |
| 1341 | CGIWDTRLSVYVF | 2165 | TGCGGAATTTGGGATACCAGGCTGAGTGTTTATGTCTTC |
| 1342 | CGIWDTRLSVYIF | 2166 | TGCGGAATTTGGGATACCAGGCTGAGTGTTTATATCTTC |
| 1343 | CGIWDTNLGYLF | 2167 | TGTGGAATATGGGATACGAATCTGGGTTATCTCTTC |
| 1344 | CGIWDTGLSAVVF | 2168 | TGCGGTATATGGGATACCGGCCTGAGTGCTGTGGTATTC |
| 1345 | CGIWDRSLSAWVF | 2169 | TGCGGAATATGGGATCGCAGCCTGAGTGCTTGGGTGTTT |
| 1346 | CGIRDTRLSVYVF | 2170 | TGCGGAATTCGGGATACCAGGCTGAGTGTTTATGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1347 | CGGWSSRLGVGPVF | 2171 | TGCGGAGGATGGAGTAGCAGACTGGGTGTTGGCCCAGTGTTT |
| 1348 | CGGWGSGLSAWVF | 2172 | TGCGGAGGATGGGGTAGCGGCCTGAGTGCTTGGGTGTTC |
| 1349 | CGGWDTSLSAWVF | 2173 | TGCGGAGGATGGGATACCAGCCTGAGTGCTTGGGTGTTC |
| 1350 | CGGWDRGLDAWVF | 2174 | TGCGGAGGATGGGATAGGGGCCTGGATGCTTGGGTTTTC |
| 1351 | CGAWRNNVWVF | 2175 | TGCGGAGCATGGCGTAATAACGTGTGGGTGTTC |
| 1352 | CGAWNRRLNPHSHWVF | 2176 | TGCGGAGCATGGAACAGGCGCCTGAATCCTCATTCTCATTGGGTGTTC |
| 1353 | CGAWHNKLSAVF | 2177 | TGCGGAGCCTGGCACAACAAACTGAGCGCGGTCTTC |
| 1354 | CGAWGSSLRASVF | 2178 | TGCGGAGCATGGGGTAGCAGCCTGAGAGCTAGTGTCTTC |
| 1355 | CGAWGSGLSAWVF | 2179 | TGCGGAGCATGGGGTAGCGGCCTGAGTGCTTGGGTGTTC |
| 1356 | CGAWESSLSAPYVF | 2180 | TGCGGAGCATGGGAAAGTAGCCTGAGTGCCCCTTATGTCTTC |
| 1357 | CGAWESSLNVGLI | 2181 | TGCGGAGCATGGGAGAGCAGCCTCAATGTTGGACTGATC |
| 1358 | CGAWESGRSAGVVF | 2182 | TGCGGAGCATGGGAGAGCGGCCGGAGTGCTGGGGTGGTGTTC |
| 1359 | CGAWDYSVSGWVF | 2183 | TGCGGAGCTTGGGATTACAGTGTGAGTGGTTGGGTGTTC |
| 1360 | CGAWDYSLTAGVF | 2184 | TGCGGAGCATGGGATTACAGCCTGACTGCCGGAGTATTC |
| 1361 | CGAWDYRLSAVLF | 2185 | TGCGGAGCCTGGGATTACAGACTGAGTGCCGTGCTATTC |
| 1362 | CGAWDVRLDVGVF | 2186 | TGCGGAGCGTGGGATGTTCGTCTGGATGTTGGGGTGTTC |
| 1363 | CGAWDTYSYVF | 2187 | TGCGGAGCATGGGATACCTACAGTTATGTCTTC |
| 1364 | CGAWDTTLSGVVF | 2188 | TGCGGAGCATGGGATACGACCCTGAGTGGTGTGGTATTC |
| 1365 | CGAWDTTLSAVIF | 2189 | TGCGGAGCGTGGGATACTACCCTGAGTGCTGTGATATTC |
| 1366 | CGAWDTSQGASYVF | 2190 | TGCGGCGCATGGGATACCAGCCAGGGTGCGTCTTATGTCTTT |
| 1367 | CGAWDTSPVRAGVF | 2191 | TGCGGAGCATGGGATACCAGCCCTGTACGTGCTGGGGTGTTC |
| 1368 | CGAWDTSLWLF | 2192 | TGCGGAGCATGGGATACCAGCCTGTGGCTTTTC |
| 1369 | CGAWDTSLTVYVF | 2193 | TGCGGAGCATGGGATACCAGCCTGACTGTTTATGTCTTC |
| 1370 | CGAWDTSLTAGVF | 2194 | TGCGGAGCATGGGACACCAGTCTGACTGCTGGGGTGTTC |
| 1371 | CGAWDTSLSTVVF | 2195 | TGCGGAGCTTGGGATACCAGCCTGAGTACTGTGGTTTTC |

TABLE 13-continued

Sequences for IGLV1-51 CDR elements

| SEQ ID NO | Amino Acid Sequence | SEQ ID NO | Nucleotide Sequence |
|---|---|---|---|
| 1372 | CGAWDTSLSSRYIF | 2196 | TGCGGAGCATGGGATACCAGCCTGAGTTCTAGATACATATTC |
| 1373 | CGAWDTSLSGYVF | 2197 | TGCGGAGCATGGGATACCAGCCTGAGTGGTTATGTCTTC |
| 1374 | CGAWDTSLSGWVF | 2198 | TGCGGAGCCTGGGATACCAGCCTGAGTGGCTGGGTGTTC |
| 1375 | CGAWDTSLSGVLF | 2199 | TGCGGAGCATGGGATACCAGTCTGAGTGGTGTGCTATTC |
| 1376 | CGAWDTSLSGLVF | 2200 | TGCGGAGCTTGGGATACCAGCTTGAGTGGTCTTGTTTTC |
| 1377 | CGAWDTSLSGFVF | 2201 | TGCGGAGCTTGGGATACCAGCTTGAGTGGTTTTGTTTTC |
| 1378 | CGAWDTSLSGEVF | 2202 | TGCGGAGCATGGGATACCAGCCTGAGTGGTGAGGTCTTT |
| 1379 | CGAWDTSLSDFVF | 2203 | TGCGGAGCTTGGGATACCAGCTTGAGTGATTTTGTTTTC |
| 1380 | CGAWDTSLRTAIF | 2204 | TGCGGAGCATGGGATACCAGCCTGCGAACTGCGATATTC |
| 1381 | CGAWDTSLRLF | 2205 | TGCGGAGCATGGGATACCAGCCTGCGGCTTTTC |
| 1382 | CGAWDTSLNVHVF | 2206 | TGCGGAGCATGGGATACCAGCCTGAATGTTCATGTCTTC |
| 1383 | CGAWDTSLNKWVF | 2207 | TGCGGAGCATGGGATACCAGCCTCAATAAATGGGTGTTC |
| 1384 | CGAWDTRLSARLF | 2208 | TGCGGAGCATGGGATACCCGCCTCAGTGCGCGGCTGTTC |
| 1385 | CGAWDTRLRGFIF | 2209 | TGCGGAGCATGGGATACCAGACTGAGGGGTTTTATTTTC |
| 1386 | CGAWDTNLGNVLL | 2210 | TGCGGAGCATGGGATACTAATTTGGGGAATGTTCTCCTC |
| 1387 | CGAWDTNLGKWVF | 2211 | TGCGGGGCATGGGATACCAACCTGGGTAAATGGGTTTTC |
| 1388 | CGAWDTGLEWYVF | 2212 | TGCGGAGCATGGGATACCGGCCTTGAGTGGTATGTTTTT |
| 1389 | CGAWDRTSGLWLF | 2213 | TGCGGAGCATGGGATAGGACTTCTGGATTGTGGCTTTTC |
| 1390 | CGAWDRSLVAGLF | 2214 | TGCGGAGCGTGGGATCGTAGCCTGGTTGCTGGACTCTTC |
| 1391 | CGAWDRSLTVYVF | 2215 | TGCGGAGCGTGGGATAGAAGCCTGACTGTTTATGTCTTC |
| 1392 | CGAWDRSLSGYVF | 2216 | TGCGGAGCATGGGATAGAAGCCTGAGTGGTTATGTCTTC |
| 1393 | CGAWDRSLSAYVF | 2217 | TGCGGAGCATGGGATAGAAGCCTGAGTGCTTATGTCTTC |
| 1394 | CGAWDRSLSAVVF | 2218 | TGCGGAGCATGGGATAGAAGCCTGAGTGCGGTGGTATTC |
| 1395 | CGAWDRSLSAGVF | 2219 | TGCGGAGCATGGGATCGCAGCCTGAGTGCTGGGGTTTTC |
| 1396 | CGAWDRSLRIVVF | 2220 | TGCGGAGCGTGGGATCGCAGCCTGCGTATTGTGGTATTC |

TABLE 13-continued

Sequences for IGLV1-51 CDR elements

| SEQ ID NO | Amino Acid Sequence | SEQ ID NO | Nucleotide Sequence |
|---|---|---|---|
| 1397 | CGAWDRSLRAYVF | 2221 | TGCGGAGCATGGGATAGAAGTCTGAGGGCTTACGTCTTC |
| 1398 | CGAWDRSLNVWLF | 2222 | TGCGGAGCATGGGATAGAAGTCTGAATGTTTGGCTGTTC |
| 1399 | CGAWDRGLNVGWLF | 2223 | TGCGGCGCCTGGGATAGGGGCCTGAATGTCGGTTGGCTTTTC |
| 1400 | CGAWDNRLSILAF | 2224 | TGCGGCGCATGGGATAATAGACTGAGTATTTTGGCCTTC |
| 1401 | CGAWDNDLTAYVF | 2225 | TGCGGAGCTTGGGATAATGACCTGACAGCTTATGTCTTC |
| 1402 | CGAWDFSLTPLF | 2226 | TGCGGGGCATGGGATTTCAGCCTGACTCCTCTCTTC |
| 1403 | CGAWDDYRGVSIYVF | 2227 | TGCGGAGCCTGGGATGACTATCGGGGTGTGAGTATTTATGTCTTC |
| 1404 | CGAWDDRPSSAVVF | 2228 | TGTGGAGCATGGGATGACCGGCCTTCGAGTGCCGTGGTTTTC |
| 1405 | CGAWDDRLTVVVF | 2229 | TGCGGAGCATGGGATGACAGACTGACTGTCGTTGTTTTC |
| 1406 | CGAWDDRLGAVF | 2230 | TGCGGAGCGTGGGATGACAGGCTGGGTGCTGTGTTC |
| 1407 | CGAWDASLNPGRAF | 2231 | TGCGGAGCGTGGGATGCCAGCCTGAATCCTGGCCGGGCATTC |
| 1408 | CGAWDAGLREIF | 2232 | TGCGGAGCATGGGATGCCGGCCTGAGGGAAATTTTC |
| 1409 | CGAWAGSPSPWVF | 2233 | TGCGGAGCTTGGGCTGGCAGTCCGAGTCCTTGGGTTTTC |
| 1410 | CGAFDTTLSAGVF | 2234 | TGCGGAGCATTCGACACCACCCTGAGTGCTGGCGTTTTC |
| 1411 | CETWESSLSVGVF | 2235 | TGCGAAACATGGGAGAGCAGCCTGAGTGTTGGGGTCTTC |
| 1412 | CETWESSLRVWVF | 2236 | TGCGAAACATGGGAAAGCAGCCTGAGGGTTTGGGTGTTC |
| 1413 | CETWDTSLSGGVF | 2237 | TGCGAAACGTGGGATACCAGCCTGAGTGGTGGGGTGTTC |
| 1414 | CETWDTSLSDFYVF | 2238 | TGCGAAACATGGGATACCAGCCTGAGTGACTTTTATGTCTTC |
| 1415 | CETWDTSLSALF | 2239 | TGCGAAACATGGGATACCAGCCTGAGTGCCCTCTTC |
| 1416 | CETWDTSLRAEVF | 2240 | TGCGAAACATGGGATACCAGCCTGCGTGCTGAAGTCTTC |
| 1417 | CETWDTSLNVVVF | 2241 | TGCGAAACATGGGATACCAGCCTGAATGTTGTGGTATTC |
| 1418 | CETWDTSLGAVVF | 2242 | TGCGAAACATGGGATACCAGCCTGGGTGCCGTGGTGTTC |
| 1419 | CETWDRSLSGVVF | 2243 | TGCGAAACATGGGATAGAAGCCTGAGTGGTGTGGTATTC |
| 1420 | CETWDRSLSAWVF | 2244 | TGCGAAACATGGGATAGGAGCCTGAGTGCTTGGGTGTTT |
| 1421 | CETWDRSLSAVVF | 2245 | TGCGAAACATGGGATCGCAGCCTGAGTGCTGTGGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1422 | CETWDRGLSVVVF | 2246 | TGCGAGACGTGGGATAGAGGCCTGAGTGTTGTGGTTTTC |
| 1423 | CETWDRGLSAVVF | 2247 | TGCGAAACATGGGATAGGGGCCTGAGTGCAGTGGTATTC |
| 1424 | CETWDHTLSVVIF | 2248 | TGCGAAACATGGGATCACACCCTGAGTGTTGTGATATTC |
| 1425 | CETWDASLTVVLF | 2249 | TGCGAAACATGGGATGCCAGCCTGACTGTTGTGTTATTC |
| 1426 | CETWDASLSAGVF | 2250 | TGCGAAACATGGGATGCCAGCCTGAGTGCTGGGGTGTTC |
| 1427 | CETWDAGLSEVVF | 2251 | TGCGAAACGTGGGATGCCGGCCTGAGTGAGGTGGTGTTC |
| 1428 | CETFDTSLSVVVF | 2252 | TGCGAAACATTTGATACCAGCCTGAGTGTTGTAGTCTTC |
| 1429 | CETFDTSLNIVVF | 2253 | TGCGAAACATTTGATACCAGCCTAAATATTGTAGTCTTT |
| 1430 | CESWDRSRIGVVF | 2254 | TGCGAATCATGGGATAGAAGCCGGATTGGTGTGGTCTTC |
| 1431 | CESWDRSLSARVY | 2255 | TGCGAAAGTTGGGACAGGAGTCTGAGTGCCCGGGTGTAC |
| 1432 | CESWDRSLRAVVF | 2256 | TGCGAATCCTGGGATAGGAGCCTGCGTGCCGTGGTCTTC |
| 1433 | CESWDRSLIVVF | 2257 | TGCGAATCTTGGGATCGTAGTTTGATTGTGGTGTTC |
| 1434 | CESWDNNLNEVVF | 2258 | TGCGAAAGTTGGGATAACAATTTAAATGAGGTGGTTTTC |
| 1435 | CEIWESSPSADDLVF | 2259 | TGCGAAATATGGGAGAGCAGCCCGAGTGCTGACGATTTGGTGTTC |
| 1436 | CEAWDTSLSGAVF | 2260 | TGCGAAGCATGGGATACCAGCCTGAGTGGTGCGGTGTTC |
| 1437 | CEAWDTSLSAGVF | 2261 | TGCGAAGCATGGGATACCAGCCTGAGTGCCGGGGTGTTC |
| 1438 | CEAWDTSLGGGVF | 2262 | TGCGAAGCATGGGATACCAGCCTGGGTGGTGGGGTGTTC |
| 1439 | CEAWDRSLTGSLF | 2263 | TGCGAAGCATGGGATCGCAGCCTGACTGGTAGCCTGTTC |
| 1440 | CEAWDRGLSAVVF | 2264 | TGCGAAGCGTGGGATAGGGGCCTGAGTGCAGTGGTATTC |
| 1441 | CEAWDNILSTVVF | 2265 | TGCGAAGCCTGGGATAACATCCTGAGTACTGTGGTGTTC |
| 1442 | CEAWDISLSAGVF | 2266 | TGCGAAGCATGGGACATCAGCCTGAGTGCTGGGGTGTTC |
| 1443 | CEAWDADLSGAVF | 2267 | TGCGAAGCATGGGATGCCGACCTGAGTGGTGCGGTGTTC |
| 1444 | CATWTGSFRTGHYVF | 2268 | TGCGCAACATGGACTGGTAGTTTCAGAACTGGCCATTATGTCTTC |
| 1445 | CATWSSSPRGWVF | 2269 | TGCGCAACATGGAGTAGCAGTCCCAGGGGGTGGGTGTTC |
| 1446 | CATWHYSLSAGRVF | 2270 | TGCGCAACATGGCATTACAGCCTGAGTGCTGGCCGAGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1447 | CATWHTSLSIVQF | 2271 | TGCGCAACATGGCATACCAGCCTGAGTATTGTGCAGTTC |
| 1448 | CATWHSTLSADVLF | 2272 | TGCGCAACATGGCATAGCACCCTGAGTGCTGATGTGCTTTTC |
| 1449 | CATWHSSLSAGRLF | 2273 | TGCGCAACATGGCATAGCAGCCTGAGTGCTGGCCGACTCTTC |
| 1450 | CATWHIARSAWVF | 2274 | TGCGCAACATGGCATATCGCTCGGAGTGCCTGGGTGTTC |
| 1451 | CATWGSSQSAVVF | 2275 | TGCGCAACATGGGGTAGTAGTCAGAGTGCCGTGGTATTC |
| 1452 | CATWGSSLSAGGVF | 2276 | TGCGCAACATGGGGTAGCAGCCTGAGTGCTGGGGGTGTTTTC |
| 1453 | CATWEYSLSVVLF | 2277 | TGTGCAACATGGGAATACAGCCTGAGTGTTGTGCTGTTC |
| 1454 | CATWETTRRASFVF | 2278 | TGCGCAACATGGGAGACCACCCGACGTGCCTCTTTTGTCTTC |
| 1455 | CATWETSLNVYVF | 2279 | TGCGCAACATGGGAGACCAGCCTGAATGTTTATGTCTTC |
| 1456 | CATWETSLNVVVF | 2280 | TGCGCAACATGGGAAACTAGCCTGAATGTTGTGGTCTTC |
| 1457 | CATWETSLNLYVF | 2281 | TGCGCAACATGGGAGACCAGCCTGAATCTTTATGTCTTC |
| 1458 | CATWETGLSAGEVF | 2282 | TGCGCAACATGGGAGACTGGCCTAAGTGCTGGAGAGGTGTTC |
| 1459 | CATWESTLSVVVF | 2283 | TGCGCGACGTGGGAGAGTACCCTAAGTGTTGTGGTTTTC |
| 1460 | CATWESSLSIFVF | 2284 | TGCGCAACGTGGGAGAGCAGCCTGAGTATTTTTGTCTTC |
| 1461 | CATWESSLNTFYVF | 2285 | TGCGCAACATGGGAAAGCAGCCTCAACACTTTTTATGTCTTC |
| 1462 | CATWESRVDTRGLLF | 2286 | TGCGCAACATGGGAGAGTAGGGTGGATACTCGAGGGTTGTTATTC |
| 1463 | CATWESGLSGAGVF | 2287 | TGCGCAACATGGGAGAGCGGCCTGAGTGGTGCGGGGGTGTTC |
| 1464 | CATWEGSLNTFYVF | 2288 | TGCGCAACATGGGAAGGCAGCCTCAACACTTTTTATGTCTTC |
| 1465 | CATWDYSLSAVVF | 2289 | TGCGCAACTTGGGATTATAGCCTGAGTGCTGTGGTGTTC |
| 1466 | CATWDYRLSIVVF | 2290 | TGCGCAACATGGGATTACAGACTGAGTATTGTGGTATTC |
| 1467 | CATWDYNLGAAVF | 2291 | TGCGCAACATGGGATTATAACCTGGGAGCTGCGGTGTTC |
| 1468 | CATWDVTLGVLHF | 2292 | TGCGCCACATGGGATGTCACCCTGGGTGTCTTGCATTTC |
| 1469 | CATWDTTLSVWVF | 2293 | TGCGCAACATGGGATACAACACTGAGTGTCTGGGTCTTC |
| 1470 | CATWDTTLSVVLF | 2294 | TGCGCAACATGGGATACCACCCTGAGTGTAGTACTTTTC |
| 1471 | CATWDTTLSVEVF | 2295 | TGCGCAACATGGGATACCACCCTGAGTGTTGAGGTCTTC |

TABLE 13-continued

Sequences for IGLV1-51 CDR elements

| SEQ ID NO | Amino Acid Sequence | SEQ ID NO | Nucleotide Sequence |
|---|---|---|---|
| 1472 | CATWDTSPSLSGFWVF | 2296 | TGCGCAACATGGGATACCAGCCCCAGCCTGAGTGGTTTTTGGGTGTTC |
| 1473 | CATWDTSLTGVVF | 2297 | TGCGCAACATGGGATACCAGCCTGACTGGTGTGGTATTC |
| 1474 | CATWDTSLTGAVF | 2298 | TGCGCAACATGGGATACCAGCCTGACTGGTGCGGTGTTC |
| 1475 | CATWDTSLTAWVF | 2299 | TGCGCAACATGGGATACCAGCCTGACTGCCTGGGTATTC |
| 1476 | CATWDTSLTAVVF | 2300 | TGCGCAACATGGGATACCAGCCTGACTGCTGTGGTTTTC |
| 1477 | CATWDTSLTAKVF | 2301 | TGCGCAACATGGGATACTAGCCTGACTGCTAAGGTGTTC |
| 1478 | CATWDTSLSVVVF | 2302 | TGCGCAACATGGGACACCAGCCTGAGTGTTGTGGTTTTC |
| 1479 | CATWDTSLSVGVF | 2303 | TGCGCTACTTGGGATACCAGCCTGAGTGTTGGGGTATTT |
| 1480 | CATWDTSLSSWVF | 2304 | TGCGCAACATGGGATACCAGCCTGAGTTCTTGGGTGTTC |
| 1481 | CATWDTSLSGGVL | 2305 | TGCGCAACATGGGATACCAGCCTGAGTGGTGGGGTACTC |
| 1482 | CATWDTSLSGGVF | 2306 | TGCGCAACATGGGATACCAGCCTGAGTGGTGGGGTGTTC |
| 1483 | CATWDTSLSGGRVF | 2307 | TGCGCAACATGGGATACCAGCCTGAGTGGTGGCCGAGTGTTC |
| 1484 | CATWDTSLSGDRVF | 2308 | TGCGCAACATGGGATACCAGCCTGAGTGGTGACCGAGTGTTC |
| 1485 | CATWDTSLSEGVF | 2309 | TGCGCAACGTGGGATACTAGCCTGAGTGAAGGGGTGTTC |
| 1486 | CATWDTSLSAVVL | 2310 | TGCGCAACCTGGGATACCAGCCTGAGTGCCGTGGTGCTC |
| 1487 | CATWDTSLSAVF | 2311 | TGCGCAACATGGGATACCAGCCTGAGTGCTGTCTTC |
| 1488 | CATWDTSLSARVF | 2312 | TGCGCGACATGGGATACCAGCCTGAGTGCTCGGGTGTTC |
| 1489 | CATWDTSLSALF | 2313 | TGCGCAACATGGGATACCAGCCTGAGTGCCTTATTC |
| 1490 | CATWDTSLSAHVF | 2314 | TGCGCAACATGGGATACCAGCCTGAGTGCTCATGTCTTC |
| 1491 | CATWDTSLSAGRVF | 2315 | TGCGCAACATGGGATACCAGCCTGAGTGCTGGCCGGGTGTTC |
| 1492 | CATWDTSLSAEVF | 2316 | TGCGCAACATGGGATACCAGCCTGAGTGCGGAGGTCTTC |
| 1493 | CATWDTSLSADAGGGVF | 2317 | TGCGCAACATGGGATACCAGCCTGAGTGCTGATGCTGGTGGGGGGGTCTTC |
| 1494 | CATWDTSLRVVVF | 2318 | TGCGCAACATGGGATACCAGCCTGCGTGTCGTGGTATTC |
| 1495 | CATWDTSLRGVF | 2319 | TGCGCAACATGGGATACCAGCCTGAGAGGGGTGTTC |
| 1496 | CATWDTSLPAWVF | 2320 | TGCGCAACATGGGATACCAGCCTGCCTGCGTGGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1497 | CATWDTSLNVGVF | 2321 | TGTGCAACATGGGATACCAGCCTGAATGTTGGGGTATTC |
| 1498 | CATWDTSLGIVLF | 2322 | TGCGCAACATGGGATACCAGCCTGGGTATTGTGTTATTT |
| 1499 | CATWDTSLGARVVF | 2323 | TGCGCAACATGGGACACCAGCCTGGGTGCGCGTGTGGTCTTC |
| 1500 | CATWDTSLGALF | 2324 | TGTGCAACGTGGGATACCAGTCTAGGTGCCTTGTTC |
| 1501 | CATWDTSLATGLF | 2325 | TGCGCAACATGGGATACCAGCCTGGCGACTGGACTGTTC |
| 1502 | CATWDTSLAAWVF | 2326 | TGCGCAACATGGGATACCAGCCTGGCTGCCTGGGTATTC |
| 1503 | CATWDTRLSAVVF | 2327 | TGCGCAACCTGGGATACCAGGCTGAGTGCTGTGGTCTTC |
| 1504 | CATWDTRLSAGVF | 2328 | TGCGCAACATGGGATACCAGGCTGAGTGCTGGGGTGTTC |
| 1505 | CATWDTRLLITVF | 2329 | TGTGCAACGTGGGACACACGTCTACTTATTACGGTTTTC |
| 1506 | CATWDTLLSVELF | 2330 | TGCGCAACATGGGACACCCTCCTGAGTGTTGAACTCTTC |
| 1507 | CATWDTGRNPHVVF | 2331 | TGCGCAACATGGGATACTGGCCGCAATCCTCATGTGGTCTTC |
| 1508 | CATWDTGLSSVLF | 2332 | TGCGCAACATGGGATACCGGCCTGTCTTCGGTGTTGTTC |
| 1509 | CATWDTGLSAVF | 2333 | TGCGCAACGTGGGATACCGGCCTGAGTGCGGTTTTC |
| 1510 | CATWDRTLSIGVF | 2334 | TGCGCTACGTGGGATAGGACCCTGAGTATTGGAGTCTTC |
| 1511 | CATWDRSVTAVLF | 2335 | TGCGCAACGTGGGATCGCAGTGTGACTGCTGTGCTCTTC |
| 1512 | CATWDRSLSGVVF | 2336 | TGCGCAACCTGGGATAGGAGCCTGAGTGGTGTGGTGTTC |
| 1513 | CATWDRSLSAVVF | 2337 | TGCGCAACATGGGATAGAAGCCTGAGTGCTGTGGTCTTC |
| 1514 | CATWDRSLSAVPWVF | 2338 | TGCGCAACATGGGATAGAAGCCTGAGTGCTGTTCCTTGGGTGTTC |
| 1515 | CATWDRSLSAGVF | 2339 | TGCGCAACATGGGATCGCAGCCTGAGTGCTGGGGTGTTC |
| 1516 | CATWDRSLRAGVF | 2340 | TGCGCAACGTGGGATAGGAGCCTGCGTGCTGGGGTGTTC |
| 1517 | CATWDRSLNVYVL | 2341 | TGCGCAACATGGGATCGCAGTCTGAATGTTTATGTCCTC |
| 1518 | CATWDRILSAEVF | 2342 | TGCGCAACGTGGGATCGCATCCTGAGCGCTGAGGTGTTC |
| 1519 | CATWDRGLSTGVF | 2343 | TGCGCAACGTGGGATAGAGGCCTGAGTACTGGGGTGTTC |
| 1520 | CATWDNYLGAAVF | 2344 | TGCGCAACATGGGATAACTACCTGGGTGCTGCCGTGTTC |
| 1521 | CATWDNTPSNIVVF | 2345 | TGCGCAACATGGGATAACACGCCTTCGAATATTGTGGTATTC |

TABLE 13-continued

Sequences for IGLV1-51 CDR elements

| SEQ ID NO | Amino Acid Sequence | SEQ ID NO | Nucleotide Sequence |
|---|---|---|---|
| 1522 | CATWDNTLSVWVF | 2346 | TGCGCAACATGGGATAATACACTGAGTGTGTGGGTCTTC |
| 1523 | CATWDNTLSVNWVF | 2347 | TGCGCAACATGGGATAACACCCTGAGTGTCAATTGGGTGTTC |
| 1524 | CATWDNTLNVFYVF | 2348 | TGCGCAACCTGGGATAACACACTGAATGTCTTTTATGTTTC |
| 1525 | CATWDNRLSSVVF | 2349 | TGTGCGACATGGGATAATCGGCTCAGTTCTGTGGTCTTC |
| 1526 | CATWDNRLSAGVL | 2350 | TGCGCAACATGGGATAACCGCCTGAGTGCTGGGGTGCTC |
| 1527 | CATWDNRLSAGVF | 2351 | TGCGCAACGTGGGATAACAGGCTGAGTGCTGGGGTGTTC |
| 1528 | CATWDNRDWVF | 2352 | TGCGCAACATGGGATAACAGGGATTGGGTCTTC |
| 1529 | CATWDNNLGAGVF | 2353 | TGCGCAACATGGGATAACAACCTGGGTGCTGGGGTGTTC |
| 1530 | CATWDNKLTSGVF | 2354 | TGCGCAACATGGGATAACAAGCTGACTTCTGGGGTCTTC |
| 1531 | CATWDNILSAWVF | 2355 | TGCGCAACATGGGATAACATCCTGAGTGCCTGGGTGTTT |
| 1532 | CATWDNDIHSGLF | 2356 | TGCGCAACCTGGGACAACGATATACATTCTGGGCTGTTC |
| 1533 | CATWDLSLSALF | 2357 | TGCGCAACTTGGGATCTCAGCCTGAGTGCCCTGTTC |
| 1534 | CATWDITLSAEVF | 2358 | TGCGCAACATGGGATATCACCCTGAGTGCTGAGGTGTTC |
| 1535 | CATWDISPSAGGVF | 2359 | TGCGCAACGTGGGATATCAGCCCGAGTGCTGGCGGGGTGTTC |
| 1536 | CATWDISLSTGRAVF | 2360 | TGCGCAACATGGGATATCAGTCTAAGTACTGGCCGGGCTGTGTTC |
| 1537 | CATWDISLSQVF | 2361 | TGCGCAACATGGGATATCAGTCTGAGTCAGGTATTC |
| 1538 | CATWDIRLSSGVF | 2362 | TGCGCAACATGGGATATCAGGCTGAGTAGTGGAGTGTTC |
| 1539 | CATWDIGPSAGGVF | 2363 | TGCGCAACGTGGGATATCGGCCCGAGTGCTGGCGGGGTGTTC |
| 1540 | CATWDHSRAGVLF | 2364 | TGCGCAACATGGGATCACAGCCGGGCTGGTGTGCTATTC |
| 1541 | CATWDHSPSVGEVF | 2365 | TGCGCAACATGGGATCACAGTCCGAGTGTTGGAGAAGTCTTC |
| 1542 | CATWDHSLRVGVF | 2366 | TGCGCAACATGGGATCACAGCCTGCGTGTTGGGGTGTTC |
| 1543 | CATWDHSLNIGVF | 2367 | TGCGCAACATGGGATCACAGCCTGAACATTGGGGTGTTC |
| 1544 | CATWDHSLGLWAF | 2368 | TGCGCAACATGGGATCACAGCCTGGGTCTTTGGGCATTC |
| 1545 | CATWDHNLRLVF | 2369 | TGCGCCACATGGGATCACAATCTGCGTCTTGTTTTC |
| 1546 | CATWDHILASGVF | 2370 | TGCGCGACTTGGGATCACATCCTGGCTTCTGGGGTGTTC |

TABLE 13-continued

Sequences for IGLV1-51 CDR elements

| SEQ ID NO | Amino Acid Sequence | SEQ ID NO | Nucleotide Sequence |
|---|---|---|---|
| 1547 | CATWDFSLSVWVF | 2371 | TGCGCAACATGGGATTTCAGCCTGAGTGTTTGGGTGTTC |
| 1548 | CATWDFSLSAWVF | 2372 | TGCGCAACATGGGATTTCAGCCTGAGTGCTTGGGTGTTC |
| 1549 | CATWDDTLTAGVF | 2373 | TGCGCAACATGGGATGACACCCTCACTGCTGGTGTGTTC |
| 1550 | CATWDDRLSAVLF | 2374 | TGCGCAACATGGGACGACAGGCTGAGTGCTGTGCTTTTC |
| 1551 | CATWDDRLDAAVF | 2375 | TGCGCAACATGGGATGACAGGCTGGATGCTGCGGTGTTC |
| 1552 | CATWDATLNTGVF | 2376 | TGCGCAACATGGGATGCGACCCTGAATACTGGGGTGTTC |
| 1553 | CATWDASLSVWLL | 2377 | TGCGCAACATGGGATGCCAGCCTGAGTGTTTGGCTGCTC |
| 1554 | CATWDASLSGGVF | 2378 | TGCGCGACATGGGATGCCAGCCTGAGTGGTGGGGTGTTC |
| 1555 | CATRDTTLSAVLF | 2379 | TGCGCAACACGGGATACCACCCTCAGCGCCGTTCTGTTC |
| 1556 | CATLGSSLSLWVF | 2380 | TGCGCTACATTGGGTAGTAGCCTGAGTCTCTGGGTGTTC |
| 1557 | CATIETSLPAWVF | 2381 | TGCGCAACAATCGAAACTAGCCTGCCTGCCTGGGTATTC |
| 1558 | CATGDRSLTVEVF | 2382 | TGCGCAACAGGGGACAGAAGCCTGACTGTTGAGGTATTC |
| 1559 | CATGDLGLTIVF | 2383 | TGCGCTACAGGGGATCTCGGCCTGACCATAGTCTTC |
| 1560 | CASWDYRGRSGWVF | 2384 | TGCGCATCATGGGATTACAGGGGGAGATCTGGTTGGGTGTTC |
| 1561 | CASWDTTLNVGVF | 2385 | TGCGCATCATGGGATACCACCCTGAATGTTGGGGTGTTC |
| 1562 | CASWDTTLGFVLF | 2386 | TGCGCTTCATGGGATACCACCCTGGGTTTTGTGTTATTC |
| 1563 | CASWDTSLSGGYVF | 2387 | TGCGCATCATGGGATACCAGCCTGAGTGGTGGTTATGTCTTC |
| 1564 | CASWDTSLRAGVF | 2388 | TGCGCATCATGGGATACCAGCCTCCGTGCTGGGGTGTTC |
| 1565 | CASWDTSLGAGVF | 2389 | TGCGCATCATGGGATACCAGCCTGGGTGCTGGGGTGTTC |
| 1566 | CASWDRGLSAVVF | 2390 | TGCGCATCATGGGACAGAGGCCTGAGTGCAGTGGTGTTC |
| 1567 | CASWDNVLRGVVF | 2391 | TGTGCTAGTTGGGATAACGTCCTGCGTGGTGTGGTATTC |
| 1568 | CASWDNRLTAVVF | 2392 | TGCGCGTCATGGGATAACAGGCTGACTGCCGTGGTTTTC |
| 1569 | CASWDASLSVAF | 2393 | TGCGCATCATGGGATGCAAGCCTGTCCGTCGCTTTC |
| 1570 | CASWDAGLSSYVF | 2394 | TGCGCTTCGTGGGATGCCGGCCTGAGTTCTTATGTCTTC |
| 1571 | CASGDTSLSGVIF | 2395 | TGCGCATCCGGGGATACCAGCCTGAGTGGTGTGATATTC |

TABLE 13-continued

Sequences for IGLV1-51 CDR elements

| SEQ ID NO | Amino Acid Sequence | SEQ ID NO | Nucleotide Sequence |
|---|---|---|---|
| 1572 | CARWHTSLSIWVF | 2396 | TGCGCAAGATGGCATACGAGCCTAAGTATTTGGGTCTTC |
| 1573 | CAIWDTGLSPGQVAF | 2397 | TGCGCAATATGGGATACCGGCCTGAGTCCTGGCCAAGTTGCCTTC |
| 1574 | CAAWHSGLGLPVF | 2398 | TGCGCAGCATGGCATAGCGGCCTGGGTCTCCCGGTCTTC |
| 1575 | CAAWDYSLSAGVF | 2399 | TGCGCAGCATGGGATTACAGCCTGAGTGCTGGGGTGTTC |
| 1576 | CAAWDTTLRVRLF | 2400 | TGCGCAGCCTGGGATACTACCCTGCGTGTTAGGCTGTTC |
| 1577 | CAAWDTSLTAWVF | 2401 | TGCGCAGCATGGGATACCAGCCTGACTGCCTGGGTTTTC |
| 1578 | CAAWDTSLSGGVF | 2402 | TGCGCAGCATGGGATACCAGCTTGAGTGGTGGGGTGTTC |
| 1579 | CAAWDTSLSGEAVF | 2403 | TGCGCAGCATGGGATACCAGCCTGAGTGGCGAGGCTGTGTTC |
| 1580 | CAAWDTSLSGAVF | 2404 | TGCGCAGCATGGGATACCAGCTTGAGTGGTGCGGTGTTC |
| 1581 | CAAWDTSLSAWVF | 2405 | TGCGCAGCATGGGATACCAGCCTGAGTGCCTGGGTGTTC |
| 1582 | CAAWDTSLSAGVF | 2406 | TGCGCAGCATGGGATACCAGCCTGAGTGCTGGGGTATTC |
| 1583 | CAAWDTSLDTYVF | 2407 | TGCGCAGCATGGGATACCAGCCTGGATACTTATGTCTTC |
| 1584 | CAAWDTRLSGVLF | 2408 | TGCGCTGCATGGGATACCCGTCTGAGTGGTGTGTTATTC |
| 1585 | CAAWDTRLSAGVF | 2409 | TGCGCAGCATGGGATACCAGGCTGAGTGCTGGGGTGTTC |
| 1586 | CAAWDRSLSTGVF | 2410 | TGCGCAGCATGGGATCGCAGTCTGAGTACTGGAGTTTTC |
| 1587 | CAAWDIRRSVLF | 2411 | TGCGCAGCGTGGGATATCCGCCGGTCTGTCCTTTTC |
| 1588 | CAAWDHTQRLSF | 2412 | TGCGCTGCGTGGGATCACACTCAGCGTCTTTCCTTC |
| 1589 | CAAWDHSLSAGQVF | 2413 | TGCGCAGCATGGGATCACAGCCTGAGTGCTGGCCAGGTGTTC |
| 1590 | CAAVDTGLKEWVF | 2414 | TGCGCAGCAGTCGATACTGGTCTGAAAGAATGGGTGTTC |

Figure 21C:
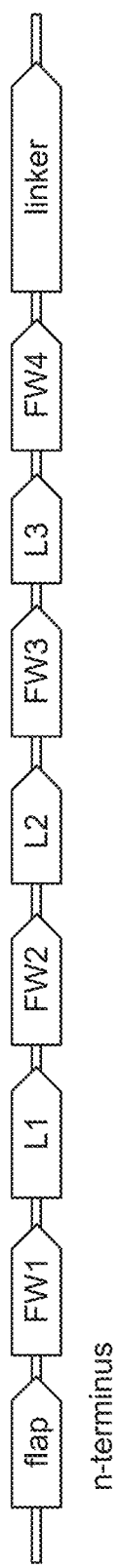
FIG. 21C depicts a schematic of four framework elements (FW1, FW2, FW3, FW4) and the variable 3 CDR (L1, L2, L3) elements for a VL or VH domain.

The CDRs were prescreened to contain no amino acid liabilities, cryptic splice sites or nucleotide restriction sites. The CDR variation was observed in at least two individuals and comprises the near-germline space of single, double and triple mutations. The order of assembly is seen in FIG. 21C.

The VH domains that were designed include IGHV1-69 and IGHV3-30. Each of two heavy chain VH domains are assembled with their respective invariant 4 framework elements (FW1, FW2, FW3, FW4) and variable 3 CDR (H1, H2, H3) elements. For IGHV1-69, 417 variants were designed for H1 and 258 variants were designed for H2. For IGHV3-30, 535 variants were designed for H1 and 165 variants were designed for H2. For the CDR H3, the same cassette was used in both IGHV1-69 and IGHV-30 since both designed use an identical FW4, and because the edge of FW3 is also identical for both IGHV1-69 and IGHV3-30. The CDR H3 comprises an N-terminus and C-terminus element that are combinatorially joined to a central middle element to generate $1 \times 10^{10}$ diversity. The N-terminal and middle element overlap with a "GGG" glycine codon. The middle and C-terminal element overlap with a "GGT" glycine codon. The CDR H3 comprises 5 subpools that were assembled separately. The various N-terminus and C-terminus elements comprise sequences as seen in Table 14.

TABLE 14

Sequences for N-terminus and C-terminus elements

| Element | SEQ ID NO | Sequence |
|---|---|---|
| Stem A | 2415 | CARDLRELECEEWT XXX SRGPCVDPRGVAGSFDVW |
| Stem B | 2416 | CARDMYYDF XXX EVVPADDAFDIW |
| Stem C | 2417 | CARDGRGSLPRPKGGP XXX YDSSEDSGGAFDIW |
| Stem D | 2418 | CARANQHF XXX GYHYYGMDVW |
| Stem E | 2419 | CAKHMSMQ XXX RADLVGDAFDVW |

Example 12. Enrichment for GPCR GLP1R Binding Proteins

Antibodies having CDR-H3 regions with a variant fragments of GPCR binding protein were generated by methods described herein were panned using cell-based methods to identified variants which are enriched for binding to particular GPCRs, as described in Example 10.

Variants of the GLP C-terminus peptide were identified (listed in Table 15) that when embedded in the CDR-H3 region of an antibody, were repeatedly and selectively enriched for binding to GPCR GLP1R.

TABLE 15

Sequences of GLP1 embedded in CDR-H3

| SEQ ID NO | Sequence |
|---|---|
| 2420 | CAKHMSMQEGAVTGEGQAAKEFIAWLVKGRVRADLVGDAFDVW |
| 2421 | CARDGRGSLPRPKGGPQTVGEGQAAKEFIAWLVKGGLTYDSSEDSGGAFDIW |
| 2422 | CAKHMSMQDYLVIGEGQAAKEFIAWLVKGGPARADLVGDAFDVW |
| 2423 | CAKHMSMQEGAVTGEGQDAKEFIAWLVKGRVRADLVGDAFDVW |
| 2424 | WAKHMSMQEGAVTGEGQAAKEFIAWLVKGRVRADLVGDAFDVW |
| 2425 | CARDGRGSLPRPKGGPQTVGEGQAAKEFIAWLVKGRVRADLVGDAFDVW |
| 2426 | CARANQHFYEQEGTFTSDVSSYLEGQAAKEFIAWLVKGGIRGYHYYGMDVW |
| 2427 | CARANQHFTELHGEGQAAKEFIAWLVKGRGQIDIGYHYYGMDVW |
| 2428 | CARANQHFLGAGVSSYLEGQAAKEFIAWLVKGDTTGYHYYGMDVW |
| 2429 | CARANQHFLDKGTFTSDVSSYLEGQAAKEFIAWLVKGIYPGYHYYGMDVW |
| 2430 | CARANQHFGTLSAGEGQAAKEFIAWLVKGGSQYDSSEDSGGAFDIW |
| 2431 | CARANQHFGLHAQGEGQAAKEFIAWLVKGSGTYGYHYYGMDVW |
| 2432 | CARANQHFGGKGEGQAAKEFIAWLVKGGGSGAGYHYYGMDVW |
| 2433 | CAKQMSMQEGAVTGEGQAAKEFIAWLVKGRVRADLVGDAFDVW |
| 2434 | CAKHMSMQEGAVTGEGQAAKEFIAWLVKGGPARADLVGDAFDVW |
| 2435 | CAKHMSMQEGAVTGEGQAAKEFIAWLVKGGLTYDSSEDSGGAFDIW |
| 2436 | CAKHMSMQDYLVIGEGQAAKEFIAWLVKGRVRADLVGDAFDVW |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (2948 sequences)

SEQ ID NO: 1 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 2 - protein, 360 aa, Homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 3 - protein, 477 aa, Homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 4 - protein, 1212 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 5 - protein, 440 aa, Homo sapiens
RPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 6 - protein, 961 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 7 - protein, 400 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 8 - protein, 380 aa, Homo sapiens
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 9 - protein, 350 aa, Homo sapiens
MDSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLKKLDSLCVSFAYINCCINPIIYVVAGQGFQGRLRKSLPSLLRNVLTEESVVRESKSFTRSTVDTMAQKTQAV

SEQ ID NO: 10 - protein, 439 aa, Homo sapiens
ELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTALNLFYLTIIGHGLSIASLLISLGIFFYFKSLSCQRITLHKNLFFSFVCNSVVTIIHLTAVANNQALVATNPVSCKVSQFIHLYLMGCNYFWMLCEGIYLHTLIVVAVFAEKQHLMWYYFLGWGFPLIPACIHAIARSLYYNDNCWISSDTHLLYIIHGPICAALLVNLFFLLNIVRVLITKLKVTHQAESNLYMKAVRATLILVPLLGIEFVLIPWRPEGKIAEEVYDYIMHILMHFQGLLVSTIFCFFNGEVQAILRRNWNQYKIQFGNSFSNSEALRSASYTVSTISDGPGYSHDCPSEHLNGKSIHDIENVLLKPENLYN

SEQ ID NO: 11 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 12 - protein, 479 aa, Homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 13 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 14 - protein, 369 aa, Homo sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 15 - protein, 333 aa, Homo sapiens
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 16 - protein, 671 aa, Homo sapiens
TPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 17 - protein, 352 aa, Homo sapiens [sequence omitted]

SEQ ID NO: 18 - protein, 678 aa, Homo sapiens
CHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTNGSTYILVPLSHLAQN

SEQ ID NO: 19 - protein, 854 aa, Homo sapiens
EGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTVASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNVKFDAPFRPADTHNEVRFDRFGDGIGRYNIFTYLRAGSGRYRYQKVGYWAEGLTLDTSLIPWASPSAGPLPASRCSEPCLQNEVKSVQPGEVCCWLCIPCQPYEYRLDEFTCADCGLGYWPNASLTGCFELPQEYIRWGDAWAVGPVTIACLGALATLFVLGVFVRHNATPVVKASGRELCYILLGGVFLCYCMTFIFIAKPSTAVCTLRRLGLGTAFSVCYSALLTKTNRIARIFGGAREGAQRPRFISPASQVAICLALISGQLLIVVAWLVVEAPGTGKETAPERREVVTLRCNHRDASMLGSLAYNVLLIALCTLYAFKTRKCPENFNEAKFIGFTMYTTCIIWLAFLPIFYVTSSDYRVQTTTMCVSVSLSGSVVLGCLFAPKLHIILFQPQKNVVSHRAPTSRFGSAAARASSSLGQGSGSQFVPTVCNGREVVDSTTSSL

SEQ ID NO: 20 - protein, 857 aa, Homo sapiens
LGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 21 - protein, 880 aa, Homo sapiens
KPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 22 - protein, 881 aa, Homo sapiens
QEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 23 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 24 - protein, 355 aa, Homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 25 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 26 - protein, 425 aa, Homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 27 - protein, 444 aa, Homo sapiens
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMIVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 28 - protein, 372 aa, Homo sapiens
IQGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 29 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 30 - protein, 886 aa, Homo sapiens
GSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 31 - protein, 508 aa, Homo sapiens
MTSTCTNSTRESNSSHTCMPLSKMPISLAHGIIRSTVLVIFLAASFVGNIVLALVLQRKPQLLQVTNRFIFNLLVTDLLQISLVAPWVVATSVPLFWPLNSHFCTALVSLTHLFAFASVNTIVVVSVDRYLSIIHPLSYPSKMTQRRGYLLLYGTWIVAILQSTPPLYGWGQAAFDERNALCSMIWGASPSYTILSVVSFIVIPLIVMIACYSVVFCAARRQHALLYNVKRHSLEVRVKDCVENEDEEGAEKKEEFQDESEFRRQHEGEVKAKEGRMEAKDGSLKAKEGSTGTSESSVEARGSEEVRESSTVASDGSMEGKEGSTKVEENSMKADKGRTEVNQCSIDLGEDDMEFGEDDINFSEDDVEAVNIPESLPPSRRNSNSNPPLPRCYQCKAAKVIFIIIFSYVLSLGPYCFLAVLAVWVDVETQVPQWVITIIIWLFFLQCCIHPYVYGYMHKTIKKEIQDMLKKFFCKEKPPKEDSHPDLPGTEGGTEGKIVPSYDSATFP

SEQ ID NO: 32 - protein, 419 aa, Homo sapiens
MLAAAFADSNSSSMNVSFAHLHFAGGYLPSDSQDWRTIIPALLVAVCLVGFVGNLCVIGILLHNAWKGKPSMIHSLILNLSLADLSLLLFSAPIRATAYSKSVWDLGWFVCKSSDWFIHTCMAAKSLTIVVVAKVCFMYASDPAKQVSIHNYTIWSVLVAIWTVASLLPLPEWFFSTIRHHEGVEMCLVDVPAVAEEFMSMFGKLYPLLAFGLPLFFASFYFWRAYDQCKKRGTKTQNLRNQIRSKQVTVMLLSIAIISALLWLPEWVAWLWVWHLKAAGPAPPQGFIALSQVLMFSISSANPLIFLVMSEEFREGLKGVWKWMITKKPPTVSESQETPAGNSEGLPDKVPSPESPASIPEKEKPSSPSSGKGKTEKAEIPILPDVEQFWHERDTVPSVQDNDPIPWEHEDQETGEGVK

SEQ ID NO: 33 - protein, 529 aa, Homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 34 - protein, 367 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 35 - protein, 361 aa, Homo sapiens [sequence omitted]

SEQ ID NO: 36 - protein, 395 aa, Homo sapiens
MSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQVALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 37 - protein, 388 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 38 - protein, 440 aa, Homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 39 - protein, 360 aa, Homo sapiens
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 40 - protein, 445 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 41 - protein, 427 aa, Homo sapiens
ARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 42 - protein, 445 aa, Homo sapiens
RAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 43 - protein, 390 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 44 - protein, 354 aa, Homo sapiens
QDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 45 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 46 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 47 - protein, 319 aa, Homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 48 - DNA, 62 bp, Artificial Sequence
  Description of Artificial Sequence: Synthetic oligonucleotide
  modified_base (51)..(52): Thymidine-succinyl hexamide CED phosphoramidite
agacaatcaaccatttggggtggacagccttgacctctagacttcggcattttttttttttt

SEQ ID NO: 49 - DNA, 112 bp, Artificial Sequence
  Description of Artificial Sequence: Synthetic polynucleotide
  modified_base (103)..(104): Thymidine-succinyl hexamide CED phosphoramidite
cgggatccttatcgtcatcgtcgtacagatcccgacccatttgctgtccaccagtcatgctagccataccatgatgatgatgatgatgagaaccccgcattttttttttttt

SEQ ID NO: 50 - DNA, 19 bp, Artificial Sequence
  Description of Artificial Sequence: Synthetic primer
atgcggggttctcatcatc

SEQ ID NO: 51 - DNA, 20 bp, Artificial Sequence
  Description of Artificial Sequence: Synthetic primer
cgggatccttatcgtcatcg

SEQ ID NO: 52 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 53 - protein, 15 aa, Artificial Sequence
  Description of Artificial Sequence: Synthetic peptide
GGGGSDYKPVSLSYR

SEQ ID NO: 54 - protein, 14 aa, Artificial Sequence
  Description of Artificial Sequence: Synthetic peptide
GGGGDYKPVSLSYR

SEQ ID NO: 55 - protein, 13 aa, Artificial Sequence
  Description of Artificial Sequence: Synthetic peptide
GGGGYKPVSLSYR

SEQ ID NO: 56 - protein, 12 aa, Artificial Sequence
  Description of Artificial Sequence: Synthetic peptide
GGGGKPVSLSYR

SEQ ID NO: 57 - protein, 11 aa, Artificial Sequence
  Description of Artificial Sequence: Synthetic peptide
GGGGPVSLSYR

SEQ ID NO: 58 - protein, 18 aa, Artificial Sequence
  Description of Artificial Sequence: Synthetic peptide
GGGGSAALCEGAVLPRSA

SEQ ID NO: 59 - protein, 17 aa, Artificial Sequence
  Description of Artificial Sequence: Synthetic peptide
GGGGAALCEGAVLPRSA

SEQ ID NO: 60 - protein, 16 aa, Artificial Sequence
  Description of Artificial Sequence: Synthetic peptide
GGGGALCEGAVLPRSA

SEQ ID NO: 61 - protein, 15 aa, Artificial Sequence
  Description of Artificial Sequence: Synthetic peptide
GGGGLCEGAVLPRSA

SEQ ID NO: 62 - protein, 14 aa, Artificial Sequence
  Description of Artificial Sequence: Synthetic peptide
GGGGCEGAVLPRSA

SEQ ID NO: 63 - protein, 20 aa, Artificial Sequence
  Description of Artificial Sequence: Synthetic peptide
GGGGSAALCEGAVLPRSAKE

SEQ ID NO: 64 - protein, 19 aa, Artificial Sequence
  Description of Artificial Sequence: Synthetic peptide
GGGGAALCEGAVLPRSAKE

SEQ ID NO: 65 - protein, 18 aa, Artificial Sequence
  Description of Artificial Sequence: Synthetic peptide
GGGGALCEGAVLPRSAKE

SEQ ID NO: 66 - protein, 17 aa, Artificial Sequence
  Description of Artificial Sequence: Synthetic peptide
GGGGLCEGAVLPRSAKE

SEQ ID NO: 67 - protein, 16 aa, Artificial Sequence
  Description of Artificial Sequence: Synthetic peptide
GGGGCEGAVLPRSAKE

SEQ ID NO: 68 - protein, 22 aa, Artificial Sequence
  Description of Artificial Sequence: Synthetic peptide
GGGGSAALCEGAVLPRSAKELR

SEQ ID NO: 69 - protein, 21 aa, Artificial Sequence
  Description of Artificial Sequence: Synthetic peptide
GGGGAALCEGAVLPRSAKELR

SEQ ID NO: 70 - protein, 20 aa, Artificial Sequence
  Description of Artificial Sequence: Synthetic peptide
GGGGALCEGAVLPRSAKELR

SEQ ID NO: 71 - protein, 19 aa, Artificial Sequence
  Description of Artificial Sequence: Synthetic peptide
GGGGLCEGAVLPRSAKELR

SEQ ID NO: 72 - protein, 18 aa, Artificial Sequence
  Description of Artificial Sequence: Synthetic peptide
GGGGCEGAVLPRSAKELR

SEQ ID NO: 73 - protein, 31 aa, Homo sapiens
HAEGTFTSDVSSYLEGQAAKEFIAWLVKGRG

SEQ ID NO: 74 - protein, 42 aa, Artificial Sequence
  Description of Artificial Sequence: Synthetic polypeptide
SGGGGSGGGGSGGGGHAEGTFTSDVSSYLEGQAAKEFIAWLV

SEQ ID NO: 75 - protein, 41 aa, Artificial Sequence
  Description of Artificial Sequence: Synthetic polypeptide
SGGGGSGGGGSGGGGAEGTFTSDVSSYLEGQAAKEFIAWLV

SEQ ID NO: 76 - protein, 40 aa, Artificial Sequence
  Description of Artificial Sequence: Synthetic polypeptide
SGGGGSGGGGSGGGGEGTFTSDVSSYLEGQAAKEFIAWLV

SEQ ID NO: 77 - protein, 39 aa, Artificial Sequence
  Description of Artificial Sequence: Synthetic polypeptide
SGGGGSGGGGSGGGGGTFTSDVSSYLEGQAAKEFIAWLV

SEQ ID NO: 78 - protein, 38 aa, Artificial Sequence
  Description of Artificial Sequence: Synthetic polypeptide
SGGGGSGGGGSGGGGTFTSDVSSYLEGQAAKEFIAWLV

SEQ ID NO: 79 - protein, 37 aa, Artificial Sequence
  Description of Artificial Sequence: Synthetic polypeptide
SGGGGSGGGGSGGGGFTSDVSSYLEGQAAKEFIAWLV

SEQ ID NO: 80 - protein, 36 aa, Artificial Sequence
  Description of Artificial Sequence: Synthetic polypeptide
SGGGGSGGGGSGGGGTSDVSSYLEGQAAKEFIAWLV

SEQ ID NO: 81 - protein, 35 aa, Artificial Sequence
  Description of Artificial Sequence: Synthetic polypeptide
SGGGGSGGGGSGGGGSDVSSYLEGQAAKEFIAWLV

SEQ ID NO: 82 - protein, 34 aa, Artificial Sequence
  Description of Artificial Sequence: Synthetic polypeptide
SGGGGSGGGGSGGGGDVSSYLEGQAAKEFIAWLV

SEQ ID NO: 83 - protein, 13 aa, Artificial Sequence
  Description of Artificial Sequence: Synthetic peptide
  MOD_RES (6)..(13): Phe, Gly, His, Pro or Tyr
SGGGGXXXXXXXX

SEQ ID NO: 84 - protein, 26 aa, Homo sapiens
EYIVLTMNRTNVNVFSELSAPRRNED

SEQ ID NO: 85 - protein, 24 aa, Artificial Sequence
  Description of Artificial Sequence: Synthetic peptide
YIVLTMNRTNVNVFSELSAPRRNE

SEQ ID NO: 86 - protein, 22 aa, Artificial Sequence
  Description of Artificial Sequence: Synthetic peptide
IVLTMNRTNVNVFSELSAPRRN

SEQ ID NO: 87 - protein, 20 aa, Artificial Sequence
  Description of Artificial Sequence: Synthetic peptide
VLTMNRTNVNVFSELSAPRR

SEQ ID NO: 88 - DNA, 45 bp, Artificial Sequence
  Description of Artificial Sequence: Synthetic oligonucleotide
gcagccgctggcttgctgctgctggcagctcagccggccatggcc

SEQ ID NO: 89 - DNA, 60 bp, Artificial Sequence
  Description of Artificial Sequence: Synthetic oligonucleotide
gctagcggtggaggcggttcaggcggaggtggctctggcggtggcggatcgcatgcatcc

SEQ ID NO: 90 - DNA, 42 bp, Artificial Sequence
  Description of Artificial Sequence: Synthetic oligonucleotide
cgcgcggccgctggaagcggctcccaccatcaccatcaccat

SEQ ID NO: 91 - protein, 22 aa, Artificial Sequence
  Description of Artificial Sequence: Synthetic peptide
QSVLTQPPSVSAAPGQKVTISC

SEQ ID NO: 92 - DNA, 66 bp, Artificial Sequence
  Description of Artificial Sequence: Synthetic oligonucleotide
cagtctgtgttgacgcagccgccctcagtgtctgcggccccaggacagaaggtcaccatctcctgc

SEQ ID NO: 93 - protein, 15 aa, Artificial Sequence
  Description of Artificial Sequence: Synthetic peptide
WYQQLPGTAPKLLIY

SEQ ID NO: 94 - DNA, 45 bp, Artificial Sequence
  Description of Artificial Sequence: Synthetic oligonucleotide
tggtatcagcagctcccaggaacagcccccaaactcctcatttat

SEQ ID NO: 95 - protein, 31 aa, Artificial Sequence
  Description of Artificial Sequence: Synthetic polypeptide
GIPDRFSGSKSGTSATLGITGLQTGDEADYY

SEQ ID NO: 96 - DNA, 93 bp, Artificial Sequence
  Description of Artificial Sequence: Synthetic oligonucleotide
gggattcctgaccgattctctggctccaagtctggcacgtcagccaccctgggcatcaccggactccagactggggacgaggccgattattac

SEQ ID NO: 97 - protein, 9 aa, Artificial Sequence
  Description of Artificial Sequence: Synthetic peptide
GGGTKLTVL

SEQ ID NO: 98 - DNA, 27 bp, Artificial Sequence
  Description of Artificial Sequence: Synthetic oligonucleotide
ggcggagggaccaagctgaccgtccta

SEQ ID NO: 99 - protein, 13 aa, Artificial Sequence
  Description of Artificial Sequence: Synthetic peptide
SGSSSNIGSNHVS

SEQ ID NO: 100 - protein, 13 aa, Artificial Sequence
  Description of Artificial Sequence: Synthetic peptide
SGSSSNIGNNYLS

SEQ ID NO: 101 - protein, 13 aa, Artificial Sequence
  Description of Artificial Sequence: Synthetic peptide
SGSSSNIANNYVS

SEQ ID NO: 102 - protein, 13 aa, Artificial Sequence
  Description of Artificial Sequence: Synthetic peptide
SGSSPNIGNNYVS

SEQ ID NO: 103 - protein, 13 aa, Artificial Sequence
  Description of Artificial Sequence: Synthetic peptide
SGSRSNIGSNYVS

SEQ ID NO: 104 - protein, 13 aa, Artificial Sequence
  Description of Artificial Sequence: Synthetic peptide
SGSSSNVGDNYVS

SEQ ID NO: 105 - protein, 13 aa, Artificial Sequence
  Description of Artificial Sequence: Synthetic peptide
SGSSSNIGIQYVS

SEQ ID NO: 106 - protein, 13 aa, Artificial Sequence
  Description of Artificial Sequence: Synthetic peptide
SGSSSNVGNNFVS

SEQ ID NO: 107 - protein, 13 aa, Artificial Sequence
  Description of Artificial Sequence: Synthetic peptide
SGSASNIGNNYVS

SEQ ID NO: 108 - protein, 13 aa, Artificial Sequence
  Description of Artificial Sequence: Synthetic peptide
SGSGSNIGNNDVS

SEQ ID NO: 109 - protein, 13 aa, Artificial Sequence
  Description of Artificial Sequence: Synthetic peptide
SGSISNIGNNYVS

SEQ ID NO: 110 - protein, 13 aa, Artificial Sequence
  Description of Artificial Sequence: Synthetic peptide
SGSISNIGKNYVS

SEQ ID NO: 111 - protein, 13 aa, Artificial Sequence
  Description of Artificial Sequence: Synthetic peptide
SGSSSNIGHNYVS

SEQ ID NO: 112 - protein, 13 aa, Artificial Sequence
  Description of Artificial Sequence: Synthetic peptide
PGSSSNIGNNYVS

SEQ ID NO: 113 - protein, 13 aa, Artificial Sequence
  Description of Artificial Sequence: Synthetic peptide
SGSTSNIGIHYVS

SEQ ID NO: 114 - protein, 13 aa, Artificial Sequence
  Description of Artificial Sequence: Synthetic peptide
SGSSSNIGSHYVS

SEQ ID NO: 115 - protein, 13 aa, Artificial Sequence
  Description of Artificial Sequence: Synthetic peptide
SGSSSNIGNEYVS

SEQ ID NO: 116 - protein, 13 aa, Artificial Sequence
  Description of Artificial Sequence: Synthetic peptide
SGSTSNIGNNYIS

SEQ ID NO: 117 - protein, 13 aa, Artificial Sequence
  Description of Artificial Sequence: Synthetic peptide
SGSSSNIGNHFVS

SEQ ID NO: 118 - protein, 13 aa, Artificial Sequence
  Description of Artificial Sequence: Synthetic peptide
SGSSSNIGNNYVA

SEQ ID NO: 119 - protein, 13 aa, Artificial Sequence
  Description of Artificial Sequence: Synthetic peptide
SGSSSNIGSYYVS

SEQ ID NO: 120 - protein, 13 aa, Artificial Sequence
  Description of Artificial Sequence: Synthetic peptide
SGSGFNIGNNYVS

SEQ ID NO: 121 - protein, 13 aa, Artificial Sequence
  Description of Artificial Sequence: Synthetic peptide
SGSTSNIGNNYVS

SEQ ID NO: 122 - protein, 13 aa, Artificial Sequence
  Description of Artificial Sequence: Synthetic peptide
SGSSSDIGNNYVS

SEQ ID NO: 123 - protein, 13 aa, Artificial Sequence
  Description of Artificial Sequence: Synthetic peptide
SGSSSNIGNNVVS

SEQ ID NO: 124 - protein, 13 aa, Artificial Sequence
  Description of Artificial Sequence: Synthetic peptide
SGSKSNIGKNYVS

SEQ ID NO: 125 - protein, 13 aa, Artificial Sequence
  Description of Artificial Sequence: Synthetic peptide
SGSSTNIGNNYVS

SEQ ID NO: 126 - protein, 13 aa, Artificial Sequence
  Description of Artificial Sequence: Synthetic peptide
SGSISNIGDNYVS

SEQ ID NO: 127 - protein, 13 aa, Artificial Sequence
  Description of Artificial Sequence: Synthetic peptide
SGSSSNIGSKDVS

SEQ ID NO: 128 - protein, 13 aa, Artificial Sequence
  Description of Artificial Sequence: Synthetic peptide
SGSSSNIENNDVS

SEQ ID NO: 129 - protein, 13 aa, Artificial Sequence
  Description of Artificial Sequence: Synthetic peptide
SGSSSNIGNHYVS

SEQ ID NO: 130 - protein, 13 aa, Artificial Sequence
  Description of Artificial Sequence: Synthetic peptide
SGSSSNIGKDFVS

SEQ ID NO: 131 - protein, 13 aa, Artificial Sequence
  Description of Artificial Sequence: Synthetic peptide
SGSTSNIGSNFVS

SEQ ID NO: 132 - protein, 13 aa, Artificial Sequence
  Description of Artificial Sequence: Synthetic peptide
SGSTSNIGHNYVS

SEQ ID NO: 133 - protein, 13 aa, Artificial Sequence
  Description of Artificial Sequence: Synthetic peptide
SASSSNIGNNYVS

SEQ ID NO: 134 - protein, 13 aa, Artificial Sequence
  Description of Artificial Sequence: Synthetic peptide
SGSSSSIGNNYVS

SEQ ID NO: 135 - protein, 13 aa, Artificial Sequence
  Description of Artificial Sequence: Synthetic peptide
SGSSSTIGNNYVS

SEQ ID NO: 136 - protein, 13 aa, Artificial Sequence
  Description of Artificial Sequence: Synthetic peptide
SGSSSNIENNYVS

SEQ ID NO: 137 - protein, 13 aa, Artificial Sequence
  Description of Artificial Sequence: Synthetic peptide
SGSSSNIGNQYVS

SEQ ID NO: 138 - protein, 13 aa, Artificial Sequence
  Description of Artificial Sequence: Synthetic peptide
SGSSSNIGNNYVF

SEQ ID NO: 139 - protein, 13 aa, Artificial Sequence
  Description of Artificial Sequence: Synthetic peptide
SGSSSNIGRNYVS

SEQ ID NO: 140 - protein, 13 aa, Artificial Sequence
  Description of Artificial Sequence: Synthetic peptide
SGGSSNIGNYYVS

SEQ ID NO: 141 - protein, 13 aa, Artificial Sequence
  Description of Artificial Sequence: Synthetic peptide
SGSSSNIGDNYVS

SEQ ID NO: 142 - protein, 13 aa, Artificial Sequence
  Description of Artificial Sequence: Synthetic peptide
SGGSSNIGINYVS

SEQ ID NO: 143 - protein, 13 aa, Artificial Sequence
  Description of Artificial Sequence: Synthetic peptide
SGGSSNIGKNYVS

SEQ ID NO: 144 - protein, 13 aa, Artificial Sequence
  Description of Artificial Sequence: Synthetic peptide
SGSSSNIGKRSVS

SEQ ID NO: 145 - protein, 13 aa, Artificial Sequence
  Description of Artificial Sequence: Synthetic peptide
SGSRSNIGNNYVS

SEQ ID NO: 146 - protein, 13 aa, Artificial Sequence
  Description of Artificial Sequence: Synthetic peptide
SGSSSNIGNNLVS

SEQ ID NO: 147 - protein, 13 aa, Artificial Sequence
  Description of Artificial Sequence: Synthetic peptide
SGSSSNIGINYVS

SEQ ID NO: 148 - protein, 13 aa, Artificial Sequence
  Description of Artificial Sequence: Synthetic peptide
SGSSSNIGNNFVS

SEQ ID NO: 149 - protein, 13 aa, Artificial Sequence
  Description of Artificial Sequence: Synthetic peptide
SGTSSNIGRNFVS

SEQ ID NO: 150 - protein, 13 aa, Artificial Sequence
  Description of Artificial Sequence: Synthetic peptide
SGRRSNIGNNYVS

SEQ ID NO: 151 - protein, 13 aa, Artificial Sequence
  Description of Artificial Sequence: Synthetic peptide
SGGSFNIGNNYVS

SEQ ID NO: 152 - protein, 13 aa, Artificial Sequence
  Description of Artificial Sequence: Synthetic peptide
SGSTSNIGENYVS

SEQ ID NO: 153 - protein, 13 aa, Artificial Sequence
  Description of Artificial Sequence: Synthetic peptide
SGSSSNIGSDYVS

SEQ ID NO: 154 - protein, 13 aa, Artificial Sequence
  Description of Artificial Sequence: Synthetic peptide
SGTSSNIGSNYVS

SEQ ID NO: 155 - protein, 13 aa, Artificial Sequence
  Description of Artificial Sequence: Synthetic peptide
SGSSSNIGTNFVS

SEQ ID NO: 156 - protein, 13 aa, Artificial Sequence
  Description of Artificial Sequence: Synthetic peptide
SGSSSNFGNNYVS

SEQ ID NO: 157 - protein, 13 aa, Artificial Sequence
  Description of Artificial Sequence: Synthetic peptide
SGSTSNIGNNHVS

SEQ ID NO: 158 - protein, 13 aa, Artificial Sequence
  Description of Artificial Sequence: Synthetic peptide
SGSSSNIGNDFVS

SEQ ID NO: 159 - protein, 13 aa, Artificial Sequence
  Description of Artificial Sequence: Synthetic peptide
SGSSSDIGDNYVS

SEQ ID NO: 160 - protein, 13 aa, Artificial Sequence
  Description of Artificial Sequence: Synthetic peptide
SGSSSNIGKYYVS

SEQ ID NO: 161 - protein, 13 aa, Artificial Sequence
  Description of Artificial Sequence: Synthetic peptide
SGSSSNIGGNYVS

SEQ ID NO: 162 - protein, 13 aa, Artificial Sequence
  Description of Artificial Sequence: Synthetic peptide
SGSSSNTGNNYVS

SEQ ID NO: 163 - protein, 13 aa, Artificial Sequence
  Description of Artificial Sequence: Synthetic peptide
SGSSSNVGNNYVS

SEQ ID NO: 164 - protein, 13 aa, Artificial Sequence
  Description of Artificial Sequence: Synthetic peptide
SGSSSNIANNFVS

SEQ ID NO: 165 - protein, 13 aa, Artificial Sequence
  Description of Artificial Sequence: Synthetic peptide
SGSSSNIGNDYVS

SEQ ID NO: 166 - protein, 13 aa, Artificial Sequence
  Description of Artificial Sequence: Synthetic peptide
SGSTSNIENNYVS

SEQ ID NO: 167 - protein, 13 aa, Artificial Sequence
  Description of Artificial Sequence: Synthetic peptide
SGGSSNIGNNDVS

SEQ ID NO: 168 - protein, 13 aa, Artificial Sequence
  Description of Artificial Sequence: Synthetic peptide
SGSTSNIGNHYVS

SEQ ID NO: 169 - protein, 13 aa, Artificial Sequence
  Description of Artificial Sequence: Synthetic peptide
SGSSSNIGDNDVS

SEQ ID NO: 170 - protein, 13 aa, Artificial Sequence
  Description of Artificial Sequence: Synthetic peptide
SGYSSNIGNNYVS

SEQ ID NO: 171 - protein, 13 aa, Artificial Sequence
  Description of Artificial Sequence: Synthetic peptide
SGSGSNIGNNFVS

SEQ ID NO: 172 - protein, 13 aa, Artificial Sequence
  Description of Artificial Sequence: Synthetic peptide
SGSSSNIWNNYVS

SEQ ID NO: 173 - protein, 13 aa, Artificial Sequence
  Description of Artificial Sequence: Synthetic peptide
FGSSSNIGNNYVS

SEQ ID NO: 174 - protein, 13 aa, Artificial Sequence
  Description of Artificial Sequence: Synthetic peptide
SGSSSNIEKNYVS

SEQ ID NO: 175 - protein, 13 aa, Artificial Sequence
  Description of Artificial Sequence: Synthetic peptide
SGSRSNIGNYYVS

SEQ ID NO: 176 - protein, 13 aa, Artificial Sequence
  Description of Artificial Sequence: Synthetic peptide
SGTKSNIGNNYVS

SEQ ID NO: 177 - protein, 13 aa, Artificial Sequence
  Description of Artificial Sequence: Synthetic peptide
SGSTSNIGNYYVS

SEQ ID NO: 178 - protein, 13 aa, Artificial Sequence
  Description of Artificial Sequence: Synthetic peptide
SGTSSNIGNNYVA

SEQ ID NO: 179 - protein, 13 aa, Artificial Sequence
  Description of Artificial Sequence: Synthetic peptide
PGTSSNIGNNYVS

SEQ ID NO: 180 - protein, 13 aa, Artificial Sequence
  Description of Artificial Sequence: Synthetic peptide
SGSTSNIGINYVS

SEQ ID NO: 181 - protein, 13 aa, Artificial Sequence
  Description of Artificial Sequence: Synthetic peptide
SGSSSNIGSNLVS

SEQ ID NO: 182 - protein, 13 aa, Artificial Sequence
  Description of Artificial Sequence: Synthetic peptide
SGSSSNIENNHVS

SEQ ID NO: 183 - protein, 13 aa, Artificial Sequence
  Description of Artificial Sequence: Synthetic peptide
SGTRSNIGNNYVS

SEQ ID NO: 184 - protein, 13 aa, Artificial Sequence
  Description of Artificial Sequence: Synthetic peptide
SGSTSNIGDNYVS

SEQ ID NO: 185 - protein, 13 aa, Artificial Sequence
  Description of Artificial Sequence: Synthetic peptide
SGGSSNIGKNFVS

SEQ ID NO: 186 - protein, 13 aa, Artificial Sequence
  Description of Artificial Sequence: Synthetic peptide
SGSRSDIGNNYVS

SEQ ID NO: 187 - protein, 13 aa, Artificial Sequence
  Description of Artificial Sequence: Synthetic peptide
SGTSSNIGNNDVS

SEQ ID NO: 188 - protein, 13 aa, Artificial Sequence
  Description of Artificial Sequence: Synthetic peptide
SGSSSNIGSKYVS

SEQ ID NO: 189 - protein, 13 aa, Artificial Sequence
  Description of Artificial Sequence: Synthetic peptide
SGSSFNIGNNYVS

SEQ ID NO: 190 - protein, 13 aa, Artificial Sequence
  Description of Artificial Sequence: Synthetic peptide
SGSSSNIGNTYVS

SEQ ID NO: 191 - protein, 13 aa, Artificial Sequence
  Description of Artificial Sequence: Synthetic peptide
SGSSSNIGDNHVS

SEQ ID NO: 192 - protein, 13 aa, Artificial Sequence
  Description of Artificial Sequence: Synthetic peptide
SGSSSNIGNNHVS

SEQ ID NO: 193 - protein, 13 aa, Artificial Sequence
  Description of Artificial Sequence: Synthetic peptide
SGSTSNIGNNDVS

SEQ ID NO: 194 - protein, 13 aa, Artificial Sequence
  Description of Artificial Sequence: Synthetic peptide
SGSRSNVGNNYVS

SEQ ID NO: 195 - protein, 13 aa, Artificial Sequence
  Description of Artificial Sequence: Synthetic peptide
SGGTSNIGKNYVS

SEQ ID NO: 196 - protein, 13 aa, Artificial Sequence
  Description of Artificial Sequence: Synthetic peptide
SGSSSNIADNYVS

SEQ ID NO: 197 - protein, 13 aa, Artificial Sequence
  Description of Artificial Sequence: Synthetic peptide
SGSSSNIGANYVS

SEQ ID NO: 198 - protein, 13 aa, Artificial Sequence
  Description of Artificial Sequence: Synthetic peptide
SGSSSNIGSNYVA

SEQ ID NO: 199 - protein, 13 aa, Artificial Sequence
  Description of Artificial Sequence: Synthetic peptide
SGSSSNIGNNFLS

SEQ ID NO: 200 - protein, 13 aa, Artificial Sequence
  Description of Artificial Sequence: Synthetic peptide
SGRSSNIGKNYVS

SEQ ID NO: 201 - protein, 13 aa, Artificial Sequence
  Description of Artificial Sequence: Synthetic peptide
SGSSPNIGANYVS

SEQ ID NO: 202 - protein, 13 aa, Artificial Sequence
  Description of Artificial Sequence: Synthetic peptide
SGSSSNIGPNYVS

SEQ ID NO: 203 - protein, 13 aa, Artificial Sequence
  Description of Artificial Sequence: Synthetic peptide
SGSSSTIGNNYIS

SEQ ID NO: 204 - protein, 13 aa, Artificial Sequence
  Description of Artificial Sequence: Synthetic peptide
SGSSSNIGNYFVS

SEQ ID NO: 205 - protein, 13 aa, Artificial Sequence
  Description of Artificial Sequence: Synthetic peptide
SGSRSNIGNNFVS

SEQ ID NO: 206 - protein, 13 aa, Artificial Sequence
  Description of Artificial Sequence: Synthetic peptide
SGGSSNIGSNFVS

SEQ ID NO: 207 - protein, 13 aa, Artificial Sequence
  Description of Artificial Sequence: Synthetic peptide
SGSSSNIGYNYVS

SEQ ID NO: 208 - protein, 13 aa, Artificial Sequence
  Description of Artificial Sequence: Synthetic peptide
SGTSSNIENNYVS

SEQ ID NO: 209 - protein, 13 aa, Artificial Sequence
  Description of Artificial Sequence: Synthetic peptide
SGSSSNIGNYYVS

SEQ ID NO: 210 - protein, 13 aa, Artificial Sequence
  Description of Artificial Sequence: Synthetic peptide
SGSTSNIGKNYVS

SEQ ID NO: 211 - protein, 13 aa, Artificial Sequence
  Description of Artificial Sequence: Synthetic peptide
SGSSSNIGTYYVS

SEQ ID NO: 212 - protein, 13 aa, Artificial Sequence
  Description of Artificial Sequence: Synthetic peptide
SGSSSNVGKNYVS

SEQ ID NO: 213 - protein, 13 aa, Artificial Sequence
  Description of Artificial Sequence: Synthetic peptide
SGSTSNIGDNFVS

SEQ ID NO: 214 - protein, 13 aa, Artificial Sequence
  Description of Artificial Sequence: Synthetic peptide
SGSTSNIGTNYVS

SEQ ID NO: 215 - protein, 13 aa, Artificial Sequence
  Description of Artificial Sequence: Synthetic peptide
SGGTSNIGNNYVS

SEQ ID NO: 216 - protein, 13 aa, Artificial Sequence
  Description of Artificial Sequence: Synthetic peptide
SGSYSNIGNNYVS

SEQ ID NO: 217 - protein, 13 aa, Artificial Sequence
  Description of Artificial Sequence: Synthetic peptide
SGSSSNIEDNYVS

SEQ ID NO: 218 - protein, 13 aa, Artificial Sequence
  Description of Artificial Sequence: Synthetic peptide
SGSSSNIGKHYVS

SEQ ID NO: 219 - protein, 13 aa, Artificial Sequence
  Description of Artificial Sequence: Synthetic peptide
SGSGSNIGSNYVS

SEQ ID NO: 220 - protein, 13 aa, Artificial Sequence
  Description of Artificial Sequence: Synthetic peptide
SGSSSNIGNNYIS

SEQ ID NO: 221 - protein, 13 aa, Artificial Sequence
  Description of Artificial Sequence: Synthetic peptide
SGASSNIGNNYVS

SEQ ID NO: 222 - protein, 13 aa, Artificial Sequence
  Description of Artificial Sequence: Synthetic peptide
SGRTSNIGNNYVS

SEQ ID NO: 223 - protein, 13 aa, Artificial Sequence
  Description of Artificial Sequence: Synthetic peptide
SGGSSNIGSNYVS

SEQ ID NO: 224 - protein, 13 aa, Artificial Sequence
  Description of Artificial Sequence: Synthetic peptide
SGSGSNIGNNYVS

SEQ ID NO: 225 - protein, 13 aa, Artificial Sequence
  Description of Artificial Sequence: Synthetic peptide
SGSTSNIGSNYVS

SEQ ID NO: 226 - protein, 13 aa, Artificial Sequence
  Description of Artificial Sequence: Synthetic peptide
SGSSSSIGNNYVA

SEQ ID NO: 227 - protein, 13 aa, Artificial Sequence
  Description of Artificial Sequence: Synthetic peptide
SGSSSNLGNNYVS

SEQ ID NO: 228 - protein, 13 aa, Artificial Sequence
  Description of Artificial Sequence: Synthetic peptide
SGTSSNIGKNYVS

SEQ ID NO: 229 - protein, 13 aa, Artificial Sequence
  Description of Artificial Sequence: Synthetic peptide
SGSSSDIGNKYIS

SEQ ID NO: 230 - protein, 13 aa, Artificial Sequence
  Description of Artificial Sequence: Synthetic peptide
SGSSSNIGSNYIS

SEQ ID NO: 231 - protein, 13 aa, Artificial Sequence
  Description of Artificial Sequence: Synthetic peptide
SGSTSNIGANYVS

SEQ ID NO: 232 - protein, 13 aa, Artificial Sequence
  Description of Artificial Sequence: Synthetic peptide
SGSSSNIGNKYVS

SEQ ID NO: 233 - protein, 13 aa, Artificial Sequence
  Description of Artificial Sequence: Synthetic peptide
SGSSSNIGNNYGS

SEQ ID NO: 234 - protein, 13 aa, Artificial Sequence
  Description of Artificial Sequence: Synthetic peptide
SGSTSNIANNYVS

SEQ ID NO: 235 - protein, 13 aa, Artificial Sequence
  Description of Artificial Sequence: Synthetic peptide
SGSYSNIGSNYVS

SEQ ID NO: 236 - protein, 13 aa, Artificial Sequence
  Description of Artificial Sequence: Synthetic peptide
SGSSSNIGSNFVS

SEQ ID NO: 237 - protein, 13 aa, Artificial Sequence
  Description of Artificial Sequence: Synthetic peptide
SGSSSNLENNYVS

SEQ ID NO: 238 - protein, 13 aa, Artificial Sequence
  Description of Artificial Sequence: Synthetic peptide
SGSISNIGSNYVS

SEQ ID NO: 239 - protein, 13 aa, Artificial Sequence
  Description of Artificial Sequence: Synthetic peptide
SGSSSDIGSNYVS

SEQ ID NO: 240 - protein, 13 aa, Artificial Sequence
  Description of Artificial Sequence: Synthetic peptide
SGSSSNIGTNYVS

SEQ ID NO: 241 - protein, 13 aa, Artificial Sequence
  Description of Artificial Sequence: Synthetic peptide
SGSSSNIGKNFVS

SEQ ID NO: 242 - protein, 13 aa, Artificial Sequence
  Description of Artificial Sequence: Synthetic peptide
SGSSSNIGNNFIS

SEQ ID NO: 243 - protein, 13 aa, Artificial Sequence
  Description of Artificial Sequence: Synthetic peptide
SGGSSNIGNNYVS

SEQ ID NO: 244 - protein, 13 aa, Artificial Sequence
  Description of Artificial Sequence: Synthetic peptide
SGSSSNIGENYVS

SEQ ID NO: 245 - protein, 13 aa, Artificial Sequence
  Description of Artificial Sequence: Synthetic peptide
SGSSSNIGNNFVA

SEQ ID NO: 246 - protein, 13 aa, Artificial Sequence
  Description of Artificial Sequence: Synthetic peptide
SGGSSNIGNNYVA

SEQ ID NO: 247 - protein, 13 aa, Artificial Sequence
  Description of Artificial Sequence: Synthetic peptide
SGSSSHIGNNYVS

SEQ ID NO: 248 - protein, 13 aa, Artificial Sequence
  Description of Artificial Sequence: Synthetic peptide
SGSSSNIGSNDVS

SEQ ID NO: 249 - protein, 13 aa, Artificial Sequence
  Description of Artificial Sequence: Synthetic peptide
SGSSSNIGNNYVT

SEQ ID NO: 250 - protein, 13 aa, Artificial Sequence
  Description of Artificial Sequence: Synthetic peptide
SGSSSNIGNNPVS

SEQ ID NO: 251 - protein, 13 aa, Artificial Sequence
  Description of Artificial Sequence: Synthetic peptide
SGGSSNIGNHYVS

SEQ ID NO: 252 - protein, 13 aa, Artificial Sequence
  Description of Artificial Sequence: Synthetic peptide
SGTSSNIGNNYVS

SEQ ID NO: 253 - protein, 13 aa, Artificial Sequence
  Description of Artificial Sequence: Synthetic peptide
SGSSSNIGSNYVS

SEQ ID NO: 254 - protein, 13 aa, Artificial Sequence
  Description of Artificial Sequence: Synthetic peptide
SGGTSNIGSNYVS

SEQ ID NO: 255 - protein, 13 aa, Artificial Sequence
  Description of Artificial Sequence: Synthetic peptide
SGSKSNIGNNYVS

SEQ ID NO: 256 - protein, 13 aa, Artificial Sequence
  Description of Artificial Sequence: Synthetic peptide
SGRSSNIGNNYVS

SEQ ID NO: 257 - protein, 13 aa, Artificial Sequence
  Description of Artificial Sequence: Synthetic peptide
SGSSSNVGSNYVS

SEQ ID NO: 258 - protein, 13 aa, Artificial Sequence
  Description of Artificial Sequence: Synthetic peptide
SGSTSNIGNNFVS

SEQ ID NO: 259 - protein, 13 aa, Artificial Sequence
  Description of Artificial Sequence: Synthetic peptide
SGSNFNIGNNYVS

SEQ ID NO: 260 - protein, 13 aa, Artificial Sequence
  Description of Artificial Sequence: Synthetic peptide
SGSTSNIGYNYVS

SEQ ID NO: 261 - protein, 13 aa, Artificial Sequence
  Description of Artificial Sequence: Synthetic peptide
SGSSSNIVSNYVS

SEQ ID NO: 262 - protein, 13 aa, Artificial Sequence
  Description of Artificial Sequence: Synthetic peptide
SGTSSNIGNNFVS

SEQ ID NO: 263 - protein, 13 aa, Artificial Sequence
  Description of Artificial Sequence: Synthetic peptide
SGSSSNIGRNFVS

SEQ ID NO: 264 - protein, 13 aa, Artificial Sequence
  Description of Artificial Sequence: Synthetic peptide
SGTTSNIGNNYVS

SEQ ID NO: 265 - protein, 13 aa, Artificial Sequence
  Description of Artificial Sequence: Synthetic peptide
SGSSSNIGNNDVS

SEQ ID NO: 266 - protein, 13 aa, Artificial Sequence
  Description of Artificial Sequence: Synthetic peptide
SGSSSNIGNHDVS

SEQ ID NO: 267 - protein, 13 aa, Artificial Sequence
  Description of Artificial Sequence: Synthetic peptide
SGSSSNIGSSHVS

SEQ ID NO: 268 - protein, 13 aa, Artificial Sequence
  Description of Artificial Sequence: Synthetic peptide
SGSSSNIGIHYVS

SEQ ID NO: 269 - protein, 13 aa, Artificial Sequence
  Description of Artificial Sequence: Synthetic peptide
SGGGSNIGYNYVS

SEQ ID NO: 270 - protein, 13 aa, Artificial Sequence
  Description of Artificial Sequence: Synthetic peptide
SGSSSNIGDHYVS

SEQ ID NO: 271 - protein, 13 aa, Artificial Sequence
  Description of Artificial Sequence: Synthetic peptide
SGSSSNLGKNYVS

SEQ ID NO: 272 - protein, 13 aa, Artificial Sequence
  Description of Artificial Sequence: Synthetic peptide
SGSSSNIGDNFVS

SEQ ID NO: 273 - protein, 13 aa, Artificial Sequence
  Description of Artificial Sequence: Synthetic peptide
SGSTSNIEKNYVS

SEQ ID NO: 274 - protein, 13 aa, Artificial Sequence
  Description of Artificial Sequence: Synthetic peptide
SGSSSNIGKDYVS

SEQ ID NO: 275 - protein, 13 aa, Artificial Sequence
  Description of Artificial Sequence: Synthetic peptide
SGSSSNIGKNYVS

SEQ ID NO: 276 - protein, 13 aa, Artificial Sequence
  Description of Artificial Sequence: Synthetic peptide
SGSSSNIGNNYVS

SEQ ID NO: 277 - protein, 13 aa, Artificial Sequence
  Description of Artificial Sequence: Synthetic peptide
SGSSSNIGNNYAS

SEQ ID NO: 278 - protein, 13 aa, Artificial Sequence
  Description of Artificial Sequence: Synthetic peptide
SGISSNIGNNYVS

SEQ ID NO: 279 - protein, 13 aa, Artificial Sequence
  Description of Artificial Sequence: Synthetic peptide
TGSSSNIGNNYVS

SEQ ID NO: 280 - protein, 13 aa, Artificial Sequence
  Description of Artificial Sequence: Synthetic peptide
SGTSSNIGNNHVS

SEQ ID NO: 281 - protein, 13 aa, Artificial Sequence
  Description of Artificial Sequence: Synthetic peptide
SGSRSNIGKNYVS

SEQ ID NO: 282 - DNA, 39 bp, Artificial Sequence
  Description of Artificial Sequence: Synthetic oligonucleotide
tctggaagcagctccaacattgggagtaatcatgtatcc

SEQ ID NO: 283 - DNA, 39 bp, Artificial Sequence
  Description of Artificial Sequence: Synthetic oligonucleotide
tctggaagcagctccaacattgggaataattatctatcc

SEQ ID NO: 284 - DNA, 39 bp, Artificial Sequence
  Description of Artificial Sequence: Synthetic oligonucleotide
tctggaagcagctccaacattgcgaataattatgtatcc

SEQ ID NO: 285 - DNA, 39 bp, Artificial Sequence
  Description of Artificial Sequence: Synthetic oligonucleotide
tctggaagcagccccaacattgggaataattatgtatcg

SEQ ID NO: 286 - DNA, 39 bp, Artificial Sequence
  Description of Artificial Sequence: Synthetic oligonucleotide
tctggaagcagatccaatattgggagtaattatgtttcg

SEQ ID NO: 287 - DNA, 39 bp, Artificial Sequence
  Description of Artificial Sequence: Synthetic oligonucleotide
tctggaagcagctccaacgttggcgataattatgtttcc

SEQ ID NO: 288 - DNA, 39 bp, Artificial Sequence
  Description of Artificial Sequence: Synthetic oligonucleotide
tctggaagcagctccaacattgggattcaatatgtatcc

SEQ ID NO: 289 - DNA, 39 bp, Artificial Sequence
  Description of Artificial Sequence: Synthetic oligonucleotide
tctggaagcagctccaatgttggtaacaattttgtctcc

SEQ ID NO: 290 - DNA, 39 bp, Artificial Sequence
  Description of Artificial Sequence: Synthetic oligonucleotide
tctggaagcgcctccaacattgggaataattatgtatcc

SEQ ID NO: 291 - DNA, 39 bp, Artificial Sequence
  Description of Artificial Sequence: Synthetic oligonucleotide
tctggaagcggctccaatattgggaataatgatgtgtcc

SEQ ID NO: 292 - DNA, 39 bp, Artificial Sequence
  Description of Artificial Sequence: Synthetic oligonucleotide
tctggaagcatctccaacattggtaataattatgtatcc

SEQ ID NO: 293 - DNA, 39 bp, Artificial Sequence
  Description of Artificial Sequence: Synthetic oligonucleotide
tctggaagcatctccaacattgggaaaaattatgtgtcg

SEQ ID NO: 294 - DNA, 39 bp, Artificial Sequence
  Description of Artificial Sequence: Synthetic oligonucleotide
tctggaagcagctccaacattgggcataattatgtatcg

SEQ ID NO: 295 - DNA, 39 bp, Artificial Sequence
  Description of Artificial Sequence: Synthetic oligonucleotide
cctggaagcagctccaacattgggaataattatgtatcc

SEQ ID NO: 296 - DNA, 39 bp, Artificial Sequence
  Description of Artificial Sequence: Synthetic oligonucleotide
tctggaagcacctccaacattggaattcattatgtatcc

SEQ ID NO: 297 - DNA, 39 bp, Artificial Sequence
  Description of Artificial Sequence: Synthetic oligonucleotide
tctggaagcagctccaacattggcagtcattatgtttcc

SEQ ID NO: 298 - DNA, 39 bp, Artificial Sequence
  Description of Artificial Sequence: Synthetic oligonucleotide
tccggaagcagctccaacattggaaatgaatatgtatcc

SEQ ID NO: 299 - DNA, 39 bp, Artificial Sequence
  Description of Artificial Sequence: Synthetic oligonucleotide
tctggaagcacctccaacattggaaataattatatatcg

SEQ ID NO: 300 - DNA, 39 bp, Artificial Sequence
  Description of Artificial Sequence: Synthetic oligonucleotide
tctggaagcagctccaatattgggaatcattttgtatcg

SEQ ID NO: 301 - DNA, 39 bp, Artificial Sequence
  Description of Artificial Sequence: Synthetic oligonucleotide
tctggaagcagctccaacattgggaataattatgtggcc

SEQ ID NO: 302 - DNA, 39 bp, Artificial Sequence
  Description of Artificial Sequence: Synthetic oligonucleotide
tctggaagcagctccaacattggaagttattatgtatcc

SEQ ID NO: 303 - DNA, 39 bp, Artificial Sequence
  Description of Artificial Sequence: Synthetic oligonucleotide
tctggaagtggtttcaacattgggaataattatgtctct

SEQ ID NO: 304 - DNA, 39 bp, Artificial Sequence
  Description of Artificial Sequence: Synthetic oligonucleotide
tctggaagcacctccaacattgggaataattatgtgtcc

SEQ ID NO: 305 - DNA, 39 bp, Artificial Sequence
  Description of Artificial Sequence: Synthetic oligonucleotide
tctggaagcagctccgacattggcaataattatgtatcc

SEQ ID NO: 306 - DNA, 39 bp, Artificial Sequence
  Description of Artificial Sequence: Synthetic oligonucleotide
tctggaagcagctccaacattgggaataatgttgtatcc

SEQ ID NO: 307 - DNA, 39 bp, Artificial Sequence
  Description of Artificial Sequence: Synthetic oligonucleotide
tctggaagcaagtctaacattgggaaaaattatgtatcc

SEQ ID NO: 308 - DNA, 39 bp, Artificial Sequence
  Description of Artificial Sequence: Synthetic oligonucleotide
tctggaagcagcaccaacattgggaataattatgtatcc

SEQ ID NO: 309 - DNA, 39 bp, Artificial Sequence
  Description of Artificial Sequence: Synthetic oligonucleotide
tctggaagcatctccaacattggggataattatgtatcc

SEQ ID NO: 310 - DNA, 39 bp, Artificial Sequence
  Description of Artificial Sequence: Synthetic oligonucleotide
tctggaagcagctccaacattgggagtaaggatgtatca

SEQ ID NO: 311 - DNA, 39 bp, Artificial Sequence
  Description of Artificial Sequence: Synthetic oligonucleotide
tctggaagcagctccaacattgagaataatgatgtatcg

SEQ ID NO: 312 - DNA, 39 bp, Artificial Sequence
  Description of Artificial Sequence: Synthetic oligonucleotide
tctggaagcagctccaacattgggaatcattatgtatcc

SEQ ID NO: 313 - DNA, 39 bp, Artificial Sequence
  Description of Artificial Sequence: Synthetic oligonucleotide
tctggaagcagctccaacattgggaaggattttgtctcc

SEQ ID NO: 314 - DNA, 39 bp, Artificial Sequence
  Description of Artificial Sequence: Synthetic oligonucleotide
tctggcagtacttccaacatcggaagtaattttgtttcc

SEQ ID NO: 315 - DNA, 39 bp, Artificial Sequence
  Description of Artificial Sequence: Synthetic oligonucleotide
tctggaagcacctccaacattgggcataattatgtatcc

SEQ ID NO: 316 - DNA, 39 bp, Artificial Sequence
  Description of Artificial Sequence: Synthetic oligonucleotide
tctgcaagcagctccaacattgggaataattatgtatcc

SEQ ID NO: 317 - DNA, 39 bp, Artificial Sequence
  Description of Artificial Sequence: Synthetic oligonucleotide
tctggaagcagctccagcattggcaataattatgtatcc

SEQ ID NO: 318 - DNA, 39 bp, Artificial Sequence
  Description of Artificial Sequence: Synthetic oligonucleotide
tctggaagcagctccaccattgggaataattatgtatcc

SEQ ID NO: 319 - DNA, 39 bp, Artificial Sequence
  Description of Artificial Sequence: Synthetic oligonucleotide
tctggaagcagctccaacattgaaaataattatgtatcc

SEQ ID NO: 320 - DNA, 39 bp, Artificial Sequence
  Description of Artificial Sequence: Synthetic oligonucleotide
tctggaagcagctccaacattgggaatcagtatgtatcc

SEQ ID NO: 321 - DNA, 39 bp, Artificial Sequence
  Description of Artificial Sequence: Synthetic oligonucleotide
tctggaagcagctccaacattgggaataattatgtattc

SEQ ID NO: 322 - DNA, 39 bp, Artificial Sequence
  Description of Artificial Sequence: Synthetic oligonucleotide
tctggaagcagctccaacattgggaggaattatgtctcc

SEQ ID NO: 323 - DNA, 39 bp, Artificial Sequence
  Description of Artificial Sequence: Synthetic oligonucleotide
tctggaggcagctccaacattggaaattattatgtatcg

SEQ ID NO: 324 - DNA, 39 bp, Artificial Sequence
  Description of Artificial Sequence: Synthetic oligonucleotide
tctggaagcagctccaacattggagataattatgtctcc

SEQ ID NO: 325 - DNA, 39 bp, Artificial Sequence
  Description of Artificial Sequence: Synthetic oligonucleotide
tctggaggcagctccaacattggaattaattatgtatcc

SEQ ID NO: 326 - DNA, 39 bp, Artificial Sequence
  Description of Artificial Sequence: Synthetic oligonucleotide
tctggaggcagctccaacattgggaagaattatgtatcc

SEQ ID NO: 327 - DNA, 39 bp, Artificial Sequence
  Description of Artificial Sequence: Synthetic oligonucleotide
tctggaagcagctccaacattgggaagagatctgtatcg

SEQ ID NO: 328 - DNA, 39 bp, Artificial Sequence
  Description of Artificial Sequence: Synthetic oligonucleotide
tctggaagcagatccaacattgggaataactatgtatcc

SEQ ID NO: 329 - DNA, 39 bp, Artificial Sequence
  Description of Artificial Sequence: Synthetic oligonucleotide
tcgggaagcagctccaacattgggaataatcttgtttcc

SEQ ID NO: 330 - DNA, 39 bp, Artificial Sequence
  Description of Artificial Sequence: Synthetic oligonucleotide
tctggaagcagctccaacattgggatcaattatgtatcc

SEQ ID NO: 331 - DNA, 39 bp, Artificial Sequence
  Description of Artificial Sequence: Synthetic oligonucleotide
tctggaagcagctccaacatcgggaataattttgtatcc

SEQ ID NO: 332 - DNA, 39 bp, Artificial Sequence
  Description of Artificial Sequence: Synthetic oligonucleotide
tctggaaccagctccaacattggcagaaattttgtatcc

SEQ ID NO: 333 - DNA, 39 bp, Artificial Sequence
  Description of Artificial Sequence: Synthetic oligonucleotide
tctggaaggaggtccaacattggaaataattatgtgtcc

SEQ ID NO: 334 - DNA, 39 bp, Artificial Sequence
  Description of Artificial Sequence: Synthetic oligonucleotide
tctggaggcagcttcaatattgggaataattatgtatcc

SEQ ID NO: 335 - DNA, 39 bp, Artificial Sequence
  Description of Artificial Sequence: Synthetic oligonucleotide
tctggaagcacttccaacattggggagaattatgtgtcc

SEQ ID NO: 336 - DNA, 39 bp, Artificial Sequence
  Description of Artificial Sequence: Synthetic oligonucleotide
tctggaagcagctccaatattgggagtgattatgtatcc

SEQ ID NO: 337 - DNA, 39 bp, Artificial Sequence
  Description of Artificial Sequence: Synthetic oligonucleotide
tctggaaccagctccaacattgggagtaattatgtatcc

SEQ ID NO: 338 - DNA, 39 bp, Artificial Sequence
  Description of Artificial Sequence: Synthetic oligonucleotide
tctggaagcagctccaacattgggactaattttgtatcc

SEQ ID NO: 339 - DNA, 39 bp, Artificial Sequence
  Description of Artificial Sequence: Synthetic oligonucleotide
tctggaagcagctccaactttgggaataattatgtatcc

SEQ ID NO: 340 - DNA, 39 bp, Artificial Sequence
  Description of Artificial Sequence: Synthetic oligonucleotide
tctggaagcacctccaacattgggaataatcatgtatcc

SEQ ID NO: 341 - DNA, 39 bp, Artificial Sequence
  Description of Artificial Sequence: Synthetic oligonucleotide
tctggaagcagctccaacattgggaatgattttgtatcc

SEQ ID NO: 342 - DNA, 39 bp, Artificial Sequence
  Description of Artificial Sequence: Synthetic oligonucleotide
tctggaagcagctccgacattggcgataattatgtgtcc

SEQ ID NO: 343 - DNA, 39 bp, Artificial Sequence
  Description of Artificial Sequence: Synthetic oligonucleotide
tctggaagcagctccaacattgggaaatattatgtatcc

SEQ ID NO: 344 - DNA, 39 bp, Artificial Sequence
  Description of Artificial Sequence: Synthetic oligonucleotide
tctggaagcagctccaacattggcggtaattatgtatcc

SEQ ID NO: 345 - DNA, 39 bp, Artificial Sequence
  Description of Artificial Sequence: Synthetic oligonucleotide
tctggaagcagctccaacactgggaataattatgtatcc

SEQ ID NO: 346 - DNA, 39 bp, Artificial Sequence
  Description of Artificial Sequence: Synthetic oligonucleotide
tctggaagcagctccaacgttgggaataattatgtgtct

SEQ ID NO: 347 - DNA, 39 bp, Artificial Sequence
  Description of Artificial Sequence: Synthetic oligonucleotide
tctggaagcagctccaacattgcgaataattttgtatcc

SEQ ID NO: 348 - DNA, 39 bp, Artificial Sequence
  Description of Artificial Sequence: Synthetic oligonucleotide
tctggaagcagctccaacattgggaatgattatgtatcc

SEQ ID NO: 349 - DNA, 39 bp, Artificial Sequence
  Description of Artificial Sequence: Synthetic oligonucleotide
tctggaagcacctccaatattgagaataattatgtttcc

SEQ ID NO: 350 - DNA, 39 bp, Artificial Sequence
  Description of Artificial Sequence: Synthetic oligonucleotide
tctggaggcagctccaatattggcaataatgatgtgtcc

SEQ ID NO: 351 - DNA, 39 bp, Artificial Sequence
  Description of Artificial Sequence: Synthetic oligonucleotide
tctggaagcacctccaacattgggaatcattatgtatcc

SEQ ID NO: 352 - DNA, 39 bp, Artificial Sequence
  Description of Artificial Sequence: Synthetic oligonucleotide
tcaggaagcagctccaatattggggataatgatgtatcc

SEQ ID NO: 353 - DNA, 39 bp, Artificial Sequence
  Description of Artificial Sequence: Synthetic oligonucleotide
tctggatacagctccaacattgggaataattatgtatcc

SEQ ID NO: 354 - DNA, 39 bp, Artificial Sequence
  Description of Artificial Sequence: Synthetic oligonucleotide
tctggaagcggctccaacattggaaataattttgtatcc

SEQ ID NO: 355 - DNA, 39 bp, Artificial Sequence
  Description of Artificial Sequence: Synthetic oligonucleotide
tctggaagcagctccaacatttggaataattatgtatcc

SEQ ID NO: 356 - DNA, 39 bp, Artificial Sequence
  Description of Artificial Sequence: Synthetic oligonucleotide
tttggaagcagctccaacattgggaataattatgtatcc

SEQ ID NO: 357 - DNA, 39 bp, Artificial Sequence
  Description of Artificial Sequence: Synthetic oligonucleotide
tctggaagcagctccaacattgagaagaattatgtatcc

SEQ ID NO: 358 - DNA, 39 bp, Artificial Sequence
  Description of Artificial Sequence: Synthetic oligonucleotide
tctggaagtagatccaatattggaaattattatgtatcc

SEQ ID NO: 359 - DNA, 39 bp, Artificial Sequence
  Description of Artificial Sequence: Synthetic oligonucleotide
tctggaaccaagtcaaacattgggaataattatgtatct

SEQ ID NO: 360 - DNA, 39 bp, Artificial Sequence
  Description of Artificial Sequence: Synthetic oligonucleotide
tctggaagcacctccaacattgggaattattatgtatcc

SEQ ID NO: 361 - DNA, 39 bp, Artificial Sequence
  Description of Artificial Sequence: Synthetic oligonucleotide
tctggaaccagctccaacattgggaataattatgtggcc

SEQ ID NO: 362 - DNA, 39 bp, Artificial Sequence
  Description of Artificial Sequence: Synthetic oligonucleotide
cctggaaccagctccaacattgggaataattatgtatcc

SEQ ID NO: 363 - DNA, 39 bp, Artificial Sequence
  Description of Artificial Sequence: Synthetic oligonucleotide
tccggaagcacctccaacattgggattaattatgtatcc

SEQ ID NO: 364 - DNA, 39 bp, Artificial Sequence
  Description of Artificial Sequence: Synthetic oligonucleotide
tctggaagcagctccaacattgggagtaatctggtatcc

SEQ ID NO: 365 - DNA, 39 bp, Artificial Sequence
  Description of Artificial Sequence: Synthetic oligonucleotide
tctggaagcagctccaacattgagaataatcatgtatcc

SEQ ID NO: 366 - DNA, 39 bp, Artificial Sequence
  Description of Artificial Sequence: Synthetic oligonucleotide
tctggaaccaggtccaacatcggcaataattatgtttcg

SEQ ID NO: 367 - DNA, 39 bp, Artificial Sequence
  Description of Artificial Sequence: Synthetic oligonucleotide
tctggaagcacctccaacattggggacaattatgtttcc

SEQ ID NO: 368 - DNA, 39 bp, Artificial Sequence
  Description of Artificial Sequence: Synthetic oligonucleotide
tctggaggcagttccaacattgggaagaattttgtatcc

SEQ ID NO: 369 - DNA, 39 bp, Artificial Sequence
  Description of Artificial Sequence: Synthetic oligonucleotide
tctggaagcaggtccgacattgggaataattatgtatcc

SEQ ID NO: 370 - DNA, 39 bp, Artificial Sequence
  Description of Artificial Sequence: Synthetic oligonucleotide
tctggaactagctccaacattgggaataatgatgtatcc

SEQ ID NO: 371 - DNA, 39 bp, Artificial Sequence
  Description of Artificial Sequence: Synthetic oligonucleotide
tctggaagcagctccaacattgggagtaaatatgtatca

SEQ ID NO: 372 - DNA, 39 bp, Artificial Sequence
  Description of Artificial Sequence: Synthetic oligonucleotide
tctggaagcagcttcaacattgggaataattatgtatcc

SEQ ID NO: 373 - DNA, 39 bp, Artificial Sequence
  Description of Artificial Sequence: Synthetic oligonucleotide
tctggaagcagctccaacattgggaatacttatgtatcc

SEQ ID NO: 374 - DNA, 39 bp, Artificial Sequence
  Description of Artificial Sequence: Synthetic oligonucleotide
tctggaagcagctccaatattggggataatcatgtatcc

SEQ ID NO: 375 - DNA, 39 bp, Artificial Sequence
  Description of Artificial Sequence: Synthetic oligonucleotide
tctggaagcagctccaacattggcaataatcatgtttcc

SEQ ID NO: 376 - DNA, 39 bp, Artificial Sequence
  Description of Artificial Sequence: Synthetic oligonucleotide
tctggaagcacctccaacattgggaataatgatgtatcc

SEQ ID NO: 377 - DNA, 39 bp, Artificial Sequence
  Description of Artificial Sequence: Synthetic oligonucleotide
tctggaagcagatccaacgttggcaataattatgtttca

SEQ ID NO: 378 - DNA, 39 bp, Artificial Sequence
  Description of Artificial Sequence: Synthetic oligonucleotide
tccggaggcacctccaacattgggaagaattatgtgtct

SEQ ID NO: 379 - DNA, 39 bp, Artificial Sequence
  Description of Artificial Sequence: Synthetic oligonucleotide
tctggaagcagctccaacattgccgataattatgtttcc

SEQ ID NO: 380 - DNA, 39 bp, Artificial Sequence
  Description of Artificial Sequence: Synthetic oligonucleotide
tctggaagcagctccaacattggcgccaattatgtatcc

SEQ ID NO: 381 - DNA, 39 bp, Artificial Sequence
  Description of Artificial Sequence: Synthetic oligonucleotide
tctggaagcagctccaacattgggagtaattatgtggcc

SEQ ID NO: 382 - DNA, 39 bp, Artificial Sequence
  Description of Artificial Sequence: Synthetic oligonucleotide
tctggaagcagctccaacattgggaacaattttctctcc

SEQ ID NO: 383 - DNA, 39 bp, Artificial Sequence
  Description of Artificial Sequence: Synthetic oligonucleotide
tctggaagaagctccaacattgggaagaattatgtatcc

SEQ ID NO: 384 - DNA, 39 bp, Artificial Sequence
  Description of Artificial Sequence: Synthetic oligonucleotide
tctggaagcagccccaacattggggctaattatgtatcc

SEQ ID NO: 385 - DNA, 39 bp, Artificial Sequence
  Description of Artificial Sequence: Synthetic oligonucleotide
tccggaagcagctccaacattgggcctaattatgtgtcc

SEQ ID NO: 386 - DNA, 39 bp, Artificial Sequence
  Description of Artificial Sequence: Synthetic oligonucleotide
tctggaagcagctccaccattgggaataattatatatcc

SEQ ID NO: 387 - DNA, 39 bp, Artificial Sequence
  Description of Artificial Sequence: Synthetic oligonucleotide
tctggaagcagctccaacattgggaattattttgtatcc

SEQ ID NO: 388 - DNA, 39 bp, Artificial Sequence
  Description of Artificial Sequence: Synthetic oligonucleotide
tctggaagccgctccaacattggtaataattttgtatcc

SEQ ID NO: 389 - DNA, 39 bp, Artificial Sequence
  Description of Artificial Sequence: Synthetic oligonucleotide
tctggaggcagctccaacattgggagtaattttgtatcc

SEQ ID NO: 390 - DNA, 39 bp, Artificial Sequence
  Description of Artificial Sequence: Synthetic oligonucleotide
tctggaagcagctccaacattgggtataattatgtatcc

SEQ ID NO: 391 - DNA, 39 bp, Artificial Sequence
  Description of Artificial Sequence: Synthetic oligonucleotide
tctggaaccagctcgaacattgagaacaattatgtatcc

SEQ ID NO: 392 - DNA, 39 bp, Artificial Sequence
  Description of Artificial Sequence: Synthetic oligonucleotide
tctggaagtagctccaacattgggaattattatgtatcc

SEQ ID NO: 393 - DNA, 39 bp, Artificial Sequence
  Description of Artificial Sequence: Synthetic oligonucleotide
tctggaagcacctccaacattgggaagaattatgtatcc

SEQ ID NO: 394 - DNA, 39 bp, Artificial Sequence
  Description of Artificial Sequence: Synthetic oligonucleotide
tctggaagcagttccaacattgggacttattatgtctct

SEQ ID NO: 395 - DNA, 39 bp, Artificial Sequence
  Description of Artificial Sequence: Synthetic oligonucleotide
tctggaagcagctccaacgttgggaaaaattatgtatct

SEQ ID NO: 396 - DNA, 39 bp, Artificial Sequence
  Description of Artificial Sequence: Synthetic oligonucleotide
tctggaagcacctccaacattggggataattttgtatcc

SEQ ID NO: 397 - DNA, 39 bp, Artificial Sequence
  Description of Artificial Sequence: Synthetic oligonucleotide
tctggaagcacctccaacattggaactaattatgtttcc

SEQ ID NO: 398 - DNA, 39 bp, Artificial Sequence
  Description of Artificial Sequence: Synthetic oligonucleotide
tctggaggtacttccaacattgggaataattatgtctcc

SEQ ID NO: 399 - DNA, 39 bp, Artificial Sequence
  Description of Artificial Sequence: Synthetic oligonucleotide
tctggaagctactccaatattgggaataattatgtatcc

SEQ ID NO: 400 - DNA, 39 bp, Artificial Sequence
  Description of Artificial Sequence: Synthetic oligonucleotide
tctggaagcagctccaacattgaagataattatgtatcc

SEQ ID NO: 401 - DNA, 39 bp, Artificial Sequence
  Description of Artificial Sequence: Synthetic oligonucleotide
tctggaagcagctccaacattgggaaacattatgtatcc

SEQ ID NO: 402 - DNA, 39 bp, Artificial Sequence
  Description of Artificial Sequence: Synthetic oligonucleotide
tccggttccggctcaaacattggaagtaattatgtctcc

SEQ ID NO: 403 - DNA, 39 bp, Artificial Sequence
  Description of Artificial Sequence: Synthetic oligonucleotide
tctggaagcagctccaacattggaaataattatatatca

SEQ ID NO: 404 - DNA, 39 bp, Artificial Sequence
  Description of Artificial Sequence: Synthetic oligonucleotide
tctggagccagttccaacattgggaataattatgtttcc

SEQ ID NO: 405 - DNA, 39 bp, Artificial Sequence
  Description of Artificial Sequence: Synthetic oligonucleotide
tctggacgcacctccaacatcgggaacaattatgtatcc

SEQ ID NO: 406 - DNA, 39 bp, Artificial Sequence
  Description of Artificial Sequence: Synthetic oligonucleotide
tctggaggcagctccaatattgggagtaattacgtatcc

SEQ ID NO: 407 - DNA, 39 bp, Artificial Sequence
  Description of Artificial Sequence: Synthetic oligonucleotide
tctggaagcggctccaacattgggaataattatgtatcc

SEQ ID NO: 408 - DNA, 39 bp, Artificial Sequence
  Description of Artificial Sequence: Synthetic oligonucleotide
tctggaagcacctccaacattgggagtaattatgtatcc

SEQ ID NO: 409 - DNA, 39 bp, Artificial Sequence
  Description of Artificial Sequence: Synthetic oligonucleotide
tctggaagcagctccagcattgggaataattatgtggcg

SEQ ID NO: 410 - DNA, 39 bp, Artificial Sequence
  Description of Artificial Sequence: Synthetic oligonucleotide
tctggaagcagttccaaccttggaaataattatgtatcc

SEQ ID NO: 411 - DNA, 39 bp, Artificial Sequence
  Description of Artificial Sequence: Synthetic oligonucleotide
tctggaaccagctccaacattgggaaaaattatgtatcc

SEQ ID NO: 412 - DNA, 39 bp, Artificial Sequence
  Description of Artificial Sequence: Synthetic oligonucleotide
tctggaagcagctccgatattgggaacaagtatatatcc

SEQ ID NO: 413 - DNA, 39 bp, Artificial Sequence
  Description of Artificial Sequence: Synthetic oligonucleotide
tctggaagcagctccaacattggaagtaattacatatcc

SEQ ID NO: 414 - DNA, 39 bp, Artificial Sequence
  Description of Artificial Sequence: Synthetic oligonucleotide
tctggaagcacctccaacattggggctaactatgtgtcc

SEQ ID NO: 415 - DNA, 39 bp, Artificial Sequence
  Description of Artificial Sequence: Synthetic oligonucleotide
tctggaagcagctccaacattgggaataagtatgtatcc

SEQ ID NO: 416 - DNA, 39 bp, Artificial Sequence
  Description of Artificial Sequence: Synthetic oligonucleotide
tctggaagcagctccaacattgggaataattatggatcc

SEQ ID NO: 417 - DNA, 39 bp, Artificial Sequence
  Description of Artificial Sequence: Synthetic oligonucleotide
tctggaagcacctccaacattgcgaataattatgtatcc

SEQ ID NO: 418 - DNA, 39 bp, Artificial Sequence
  Description of Artificial Sequence: Synthetic oligonucleotide
tctggaagctactccaatattgggagtaattatgtatcc

SEQ ID NO: 419 - DNA, 39 bp, Artificial Sequence
  Description of Artificial Sequence: Synthetic oligonucleotide
tctggaagcagctccaacattgggagtaattttgtatcc

SEQ ID NO: 420 - DNA, 39 bp, Artificial Sequence
  Description of Artificial Sequence: Synthetic oligonucleotide
tctggaagcagctccaatcttgagaataattatgtatcc

SEQ ID NO: 421 - DNA, 39 bp, Artificial Sequence
  Description of Artificial Sequence: Synthetic oligonucleotide
tctggaagcatctccaatattggcagtaattatgtatcc

SEQ ID NO: 422 - DNA, 39 bp, Artificial Sequence
  Description of Artificial Sequence: Synthetic oligonucleotide
tctggaagcagctccgacattgggagtaattatgtatcc

SEQ ID NO: 423 - DNA, 39 bp, Artificial Sequence
  Description of Artificial Sequence: Synthetic oligonucleotide
tctggaagcagctccaacattgggactaattatgtatcc

SEQ ID NO: 424 - DNA, 39 bp, Artificial Sequence
  Description of Artificial Sequence: Synthetic oligonucleotide
tctggaagcagctccaacattgggaagaattttgtatcc

SEQ ID NO: 425 - DNA, 39 bp, Artificial Sequence
  Description of Artificial Sequence: Synthetic oligonucleotide
tctggaagcagctccaacattgggaataattttatatcc

SEQ ID NO: 426 - DNA, 39 bp, Artificial Sequence
  Description of Artificial Sequence: Synthetic oligonucleotide
tctggaggcagctccaacattggcaataattatgtttcc

SEQ ID NO: 427 - DNA, 39 bp, Artificial Sequence
  Description of Artificial Sequence: Synthetic oligonucleotide
tctggaagcagctccaacattggggagaattatgtatcc

SEQ ID NO: 428 - DNA, 39 bp, Artificial Sequence
  Description of Artificial Sequence: Synthetic oligonucleotide
tctggaagcagctccaatattgggaataattttgtggcc

SEQ ID NO: 429 - DNA, 39 bp, Artificial Sequence
  Description of Artificial Sequence: Synthetic oligonucleotide
tctggaggcagctccaacattgggaataattatgtagcc

SEQ ID NO: 430 - DNA, 39 bp, Artificial Sequence
  Description of Artificial Sequence: Synthetic oligonucleotide
tctggaagcagctcccacattggaaataattatgtatcc

SEQ ID NO: 431 - DNA, 39 bp, Artificial Sequence
  Description of Artificial Sequence: Synthetic oligonucleotide
tctggaagcagctccaatattggaagtaatgatgtatcg

SEQ ID NO: 432 - DNA, 39 bp, Artificial Sequence
  Description of Artificial Sequence: Synthetic oligonucleotide
tctggaagcagctccaacattgggaataattatgtaacc

SEQ ID NO: 433 - DNA, 39 bp, Artificial Sequence
  Description of Artificial Sequence: Synthetic oligonucleotide
tctggaagcagctccaacattgggaataatcctgtatcc

SEQ ID NO: 434 - DNA, 39 bp, Artificial Sequence
  Description of Artificial Sequence: Synthetic oligonucleotide
tctggaggcagctccaatattgggaatcattatgtatcc

SEQ ID NO: 435 - DNA, 39 bp, Artificial Sequence
  Description of Artificial Sequence: Synthetic oligonucleotide
tctggaaccagctccaacattgggaataattatgtatcc

SEQ ID NO: 436 - DNA, 39 bp, Artificial Sequence
  Description of Artificial Sequence: Synthetic oligonucleotide
tctggaagcagctccaacattggaagtaattatgtctcg

SEQ ID NO: 437 - DNA, 39 bp, Artificial Sequence
  Description of Artificial Sequence: Synthetic oligonucleotide
tctggaggcacctccaacattggaagtaattatgtatcc

SEQ ID NO: 438 - DNA, 39 bp, Artificial Sequence
  Description of Artificial Sequence: Synthetic oligonucleotide
tctggaagcaagtccaacattgggaataattatgtatcc

SEQ ID NO: 439 - DNA, 39 bp, Artificial Sequence
  Description of Artificial Sequence: Synthetic oligonucleotide
tctggaagaagctccaacattgggaataattatgtatcg

SEQ ID NO: 440 - DNA, 39 bp, Artificial Sequence
  Description of Artificial Sequence: Synthetic oligonucleotide
tctggaagcagctccaacgttgggagtaattatgtttcc

SEQ ID NO: 441 - DNA, 39 bp, Artificial Sequence
  Description of Artificial Sequence: Synthetic oligonucleotide
tctggaagcacctccaatattgggaataattttgtatcc

SEQ ID NO: 442 - DNA, 39 bp, Artificial Sequence
  Description of Artificial Sequence: Synthetic oligonucleotide
tctggaagcaacttcaacattgggaataattatgtctcc

SEQ ID NO: 443 - DNA, 39 bp, Artificial Sequence
  Description of Artificial Sequence: Synthetic oligonucleotide
tctggaagcacctccaatattggatataattatgtatcc

SEQ ID NO: 444 - DNA, 39 bp, Artificial Sequence
  Description of Artificial Sequence: Synthetic oligonucleotide
tctggaagcagctccaatattgtaagtaattatgtatcc

SEQ ID NO: 445 - DNA, 39 bp, Artificial Sequence
  Description of Artificial Sequence: Synthetic oligonucleotide
tctggaaccagctccaacattgggaataattttgtatcc

SEQ ID NO: 446 - DNA, 39 bp, Artificial Sequence
  Description of Artificial Sequence: Synthetic oligonucleotide
tctggaagcagctccaacattgggaggaattttgtgtcc

SEQ ID NO: 447 - DNA, 39 bp, Artificial Sequence
  Description of Artificial Sequence: Synthetic oligonucleotide
tctggaacgacctccaacattgggaataattatgtctcc

SEQ ID NO: 448 - DNA, 39 bp, Artificial Sequence
  Description of Artificial Sequence: Synthetic oligonucleotide
tctggaagcagctccaacattgggaataatgatgtatcc

SEQ ID NO: 449 - DNA, 39 bp, Artificial Sequence
  Description of Artificial Sequence: Synthetic oligonucleotide
tctggaagcagctccaacattgggaatcatgatgtatcc

SEQ ID NO: 450 - DNA, 39 bp, Artificial Sequence
  Description of Artificial Sequence: Synthetic oligonucleotide
tctggaagcagctccaacattggaagtagtcatgtatcc

SEQ ID NO: 451 - DNA, 39 bp, Artificial Sequence
  Description of Artificial Sequence: Synthetic oligonucleotide
tctggaagcagctccaacattgggattcattatgtatcc

SEQ ID NO: 452 - DNA, 39 bp, Artificial Sequence
  Description of Artificial Sequence: Synthetic oligonucleotide
tctggaggcggctccaacattggctataattatgtctcc

SEQ ID NO: 453 - DNA, 39 bp, Artificial Sequence
  Description of Artificial Sequence: Synthetic oligonucleotide
tctggaagcagctccaacattggggatcattatgtgtcg

SEQ ID NO: 454 - DNA, 39 bp, Artificial Sequence
  Description of Artificial Sequence: Synthetic oligonucleotide
tctggaagcagctccaaccttgggaagaattatgtatct

SEQ ID NO: 455 - DNA, 39 bp, Artificial Sequence
  Description of Artificial Sequence: Synthetic oligonucleotide
tctggaagcagctccaacattggcgataattttgtatcc

SEQ ID NO: 456 - DNA, 39 bp, Artificial Sequence
  Description of Artificial Sequence: Synthetic oligonucleotide
tctggaagcacctccaacattgagaaaaactatgtatcg

SEQ ID NO: 457 - DNA, 39 bp, Artificial Sequence
  Description of Artificial Sequence: Synthetic oligonucleotide
tctggaagcagctccaacattgggaaggattatgtatcc

SEQ ID NO: 458 - DNA, 39 bp, Artificial Sequence
  Description of Artificial Sequence: Synthetic oligonucleotide
tctggaagcagctccaacattgggaagaattatgtatcc

SEQ ID NO: 459 - DNA, 39 bp, Artificial Sequence
  Description of Artificial Sequence: Synthetic oligonucleotide
tctggaagcagctccaacattgggaataattatgtatcc

SEQ ID NO: 460 - DNA, 39 bp, Artificial Sequence
  Description of Artificial Sequence: Synthetic oligonucleotide
tctggaagcagctccaacattgggaataattatgcctcc

SEQ ID NO: 461 - DNA, 39 bp, Artificial Sequence
  Description of Artificial Sequence: Synthetic oligonucleotide
tctggaatcagctccaacattgggaataattatgtatcc

SEQ ID NO: 462 - DNA, 39 bp, Artificial Sequence
  Description of Artificial Sequence: Synthetic oligonucleotide
actggaagcagctccaacattgggaataattatgtatcc

SEQ ID NO: 463 - DNA, 39 bp, Artificial Sequence
  Description of Artificial Sequence: Synthetic oligonucleotide
tctggaaccagctccaacattgggaataatcatgtttcc

SEQ ID NO: 464 - DNA, 39 bp, Artificial Sequence
  Description of Artificial Sequence: Synthetic oligonucleotide
tctggaagtcgttccaacattgggaaaaattatgtatcc

SEQ ID NO: 465 - protein, 7 aa, Artificial Sequence
  Description of Artificial Sequence: Synthetic peptide
DNNKRPP

SEQ ID NO: 466 - protein, 7 aa, Artificial Sequence
  Description of Artificial Sequence: Synthetic peptide
ENNRRPS

SEQ ID NO: 467 - protein, 7 aa, Artificial Sequence
  Description of Artificial Sequence: Synthetic peptide
DNNKQPS

SEQ ID NO: 468 - protein, 7 aa, Artificial Sequence
  Description of Artificial Sequence: Synthetic peptide
DNNKRPL

SEQ ID NO: 469 - protein, 7 aa, Artificial Sequence
  Description of Artificial Sequence: Synthetic peptide
DNDKRPA

SEQ ID NO: 470 - protein, 7 aa, Artificial Sequence
  Description of Artificial Sequence: Synthetic peptide
DNHERPS

SEQ ID NO: 471 - protein, 7 aa, Artificial Sequence
  Description of Artificial Sequence: Synthetic peptide
ENRKRPS

SEQ ID NO: 472 - protein, 7 aa, Artificial Sequence
  Description of Artificial Sequence: Synthetic peptide
DNDQRPS

SEQ ID NO: 473 - protein, 7 aa, Artificial Sequence
  Description of Artificial Sequence: Synthetic peptide
ENYKRPS

SEQ ID NO: 474 - protein, 7 aa, Artificial Sequence
  Description of Artificial Sequence: Synthetic peptide
ENTKRPS

SEQ ID NO: 475 - protein, 7 aa, Artificial Sequence
  Description of Artificial Sequence: Synthetic peptide
DTEKRPS

SEQ ID NO: 476 - protein, 7 aa, Artificial Sequence
  Description of Artificial Sequence: Synthetic peptide
DNDKRPP

SEQ ID NO: 477 - protein, 7 aa, Artificial Sequence
  Description of Artificial Sequence: Synthetic peptide
DHNKRPS

SEQ ID NO: 478 - protein, 7 aa, Artificial Sequence
  Description of Artificial Sequence: Synthetic peptide
GNNERPS

SEQ ID NO: 479 - protein, 7 aa, Artificial Sequence
  Description of Artificial Sequence: Synthetic peptide
DTSKRPS

SEQ ID NO: 480 - protein, 7 aa, Artificial Sequence
  Description of Artificial Sequence: Synthetic peptide
EYNKRPS

SEQ ID NO: 481 - protein, 7 aa, Artificial Sequence
  Description of Artificial Sequence: Synthetic peptide
ENIKRPS

SEQ ID NO: 482 - protein, 7 aa, Artificial Sequence
  Description of Artificial Sequence: Synthetic peptide
DNVKRPS

SEQ ID NO: 483 - protein, 7 aa, Artificial Sequence
  Description of Artificial Sequence: Synthetic peptide
ENDKRSS

SEQ ID NO: 484 - protein, 7 aa, Artificial Sequence
  Description of Artificial Sequence: Synthetic peptide
ENNKRHS

SEQ ID NO: 485 - protein, 7 aa, Artificial Sequence
  Description of Artificial Sequence: Synthetic peptide
GNDQRPS

SEQ ID NO: 486 - protein, 7 aa, Artificial Sequence
  Description of Artificial Sequence: Synthetic peptide
DNDRRPS

SEQ ID NO: 487 - protein, 7 aa, Artificial Sequence
  Description of Artificial Sequence: Synthetic peptide
DNHKRPS

SEQ ID NO: 488 - protein, 7 aa, Artificial Sequence
  Description of Artificial Sequence: Synthetic peptide
DNNDRPS

SEQ ID NO: 489 - protein, 7 aa, Artificial Sequence
  Description of Artificial Sequence: Synthetic peptide
ENNQRPS

SEQ ID NO: 490 - protein, 7 aa, Artificial Sequence
  Description of Artificial Sequence: Synthetic peptide
DNNQRPS

SEQ ID NO: 491 - protein, 7 aa, Artificial Sequence
  Description of Artificial Sequence: Synthetic peptide
ENVKRPS

SEQ ID NO: 492 - protein, 7 aa, Artificial Sequence
  Description of Artificial Sequence: Synthetic peptide
DTYKRPS

SEQ ID NO: 493 - protein, 7 aa, Artificial Sequence
  Description of Artificial Sequence: Synthetic peptide
NNNNRPS

SEQ ID NO: 494 - protein, 7 aa, Artificial Sequence
  Description of Artificial Sequence: Synthetic peptide
GNNNRPS

SEQ ID NO: 495 - protein, 7 aa, Artificial Sequence
  Description of Artificial Sequence: Synthetic peptide
ENDQRPS

SEQ ID NO: 496 - protein, 7 aa, Artificial Sequence
  Description of Artificial Sequence: Synthetic peptide
DNNKRAS

SEQ ID NO: 497 - protein, 7 aa, Artificial Sequence
  Description of Artificial Sequence: Synthetic peptide
DNDKRPL

SEQ ID NO: 498 - protein, 7 aa, Artificial Sequence
  Description of Artificial Sequence: Synthetic peptide
DTDERPS

SEQ ID NO: 499 - protein, 7 aa, Artificial Sequence
  Description of Artificial Sequence: Synthetic peptide
DNRKRPS

SEQ ID NO: 500 - protein, 7 aa, Artificial Sequence
  Description of Artificial Sequence: Synthetic peptide
DNDARPS

SEQ ID NO: 501 - protein, 7 aa, Artificial Sequence
  Description of Artificial Sequence: Synthetic peptide
DNNKRLS

SEQ ID NO: 502 - protein, 7 aa, Artificial Sequence
  Description of Artificial Sequence: Synthetic peptide
DNDKRAS

SEQ ID NO: 503 - protein, 7 aa, Artificial Sequence
  Description of Artificial Sequence: Synthetic peptide
DNTERPS

SEQ ID NO: 504 - protein, 7 aa, Artificial Sequence
  Description of Artificial Sequence: Synthetic peptide
DNNIRPS

SEQ ID NO: 505 - protein, 7 aa, Artificial Sequence
  Description of Artificial Sequence: Synthetic peptide
DNKRRPS

SEQ ID NO: 506 - protein, 7 aa, Artificial Sequence
  Description of Artificial Sequence: Synthetic peptide
DDNNRPS

SEQ ID NO: 507 - protein, 7 aa, Artificial Sequence
  Description of Artificial Sequence: Synthetic peptide
ANNRRPS

SEQ ID NO: 508 - protein, 7 aa, Artificial Sequence
  Description of Artificial Sequence: Synthetic peptide
DNDKRLS

SEQ ID NO: 509 - protein, 7 aa, Artificial Sequence
  Description of Artificial Sequence: Synthetic peptide
DNNKRPA

SEQ ID NO: 510 - protein, 7 aa, Artificial Sequence
  Description of Artificial Sequence: Synthetic peptide
DNYRRPS

SEQ ID NO: 511 - protein, 7 aa, Artificial Sequence
  Description of Artificial Sequence: Synthetic peptide
ANDQRPS

SEQ ID NO: 512 - protein, 7 aa, Artificial Sequence
  Description of Artificial Sequence: Synthetic peptide
DNDKRRS

SEQ ID NO: 513 - protein, 7 aa, Artificial Sequence
  Description of Artificial Sequence: Synthetic peptide
DKNERPS

SEQ ID NO: 514 - protein, 7 aa, Artificial Sequence
  Description of Artificial Sequence: Synthetic peptide
DNKERPS

SEQ ID NO: 515 - protein, 7 aa, Artificial Sequence
  Description of Artificial Sequence: Synthetic peptide
DNNKGPS

SEQ ID NO: 516 - protein, 7 aa, Artificial Sequence
  Description of Artificial Sequence: Synthetic peptide
ENDRRPS

SEQ ID NO: 517 - protein, 7 aa, Artificial Sequence
  Description of Artificial Sequence: Synthetic peptide
ENDERPS

SEQ ID NO: 518 - protein, 7 aa, Artificial Sequence
  Description of Artificial Sequence: Synthetic peptide
QNNKRPS

SEQ ID NO: 519 - protein, 7 aa, Artificial Sequence
  Description of Artificial Sequence: Synthetic peptide
DNRERPS

SEQ ID NO: 520 - protein, 7 aa, Artificial Sequence
  Description of Artificial Sequence: Synthetic peptide
DNNRRPS

SEQ ID NO: 521 - protein, 7 aa, Artificial Sequence
  Description of Artificial Sequence: Synthetic peptide
GNNRRPS

SEQ ID NO: 522 - protein, 7 aa, Artificial Sequence
  Description of Artificial Sequence: Synthetic peptide
DNDNRPS

SEQ ID NO: 523 - protein, 7 aa, Artificial Sequence
  Description of Artificial Sequence: Synthetic peptide
EDNKRPS

SEQ ID NO: 524 - protein, 7 aa, Artificial Sequence
  Description of Artificial Sequence: Synthetic peptide
DDDERPS

SEQ ID NO: 525 - protein, 7 aa, Artificial Sequence
  Description of Artificial Sequence: Synthetic peptide
ASNKRPS

SEQ ID NO: 526 - protein, 7 aa, Artificial Sequence
  Description of Artificial Sequence: Synthetic peptide
DNNKRSS

SEQ ID NO: 527 - protein, 7 aa, Artificial Sequence
  Description of Artificial Sequence: Synthetic peptide
QNNERPS

SEQ ID NO: 528 - protein, 7 aa, Artificial Sequence
  Description of Artificial Sequence: Synthetic peptide
DDDRRPS

SEQ ID NO: 529 - protein, 7 aa, Artificial Sequence
  Description of Artificial Sequence: Synthetic peptide
NNDKRPS

SEQ ID NO: 530 - protein, 7 aa, Artificial Sequence
  Description of Artificial Sequence: Synthetic peptide
DNNNRPS

SEQ ID NO: 531 - protein, 7 aa, Artificial Sequence
  Description of Artificial Sequence: Synthetic peptide
DNNVRPS

SEQ ID NO: 532 - protein, 7 aa, Artificial Sequence
  Description of Artificial Sequence: Synthetic peptide
ENNERPS

SEQ ID NO: 533 - protein, 7 aa, Artificial Sequence
  Description of Artificial Sequence: Synthetic peptide
DNNHRPS

SEQ ID NO: 534 - protein, 7 aa, Artificial Sequence
  Description of Artificial Sequence: Synthetic peptide
DNDERPS

SEQ ID NO: 535 - protein, 7 aa, Artificial Sequence
  Description of Artificial Sequence: Synthetic peptide
DNIRRPS

SEQ ID NO: 536 - protein, 7 aa, Artificial Sequence
  Description of Artificial Sequence: Synthetic peptide
DFNKRPS

SEQ ID NO: 537 - protein, 7 aa, Artificial Sequence
  Description of Artificial Sequence: Synthetic peptide
ETNKRPS

SEQ ID NO: 538 - protein, 7 aa, Artificial Sequence
  Description of Artificial Sequence: Synthetic peptide
NDNKRPS

SEQ ID NO: 539 - protein, 7 aa, Artificial Sequence
  Description of Artificial Sequence: Synthetic peptide
DDNKRPS

SEQ ID NO: 540 - protein, 7 aa, Artificial Sequence
  Description of Artificial Sequence: Synthetic peptide
DNYKRPS

SEQ ID NO: 541 - protein, 7 aa, Artificial Sequence
  Description of Artificial Sequence: Synthetic peptide
HNNKRPS

SEQ ID NO: 542 - protein, 7 aa, Artificial Sequence
  Description of Artificial Sequence: Synthetic peptide
DNHQRPS

SEQ ID NO: 543 - protein, 7 aa, Artificial Sequence
  Description of Artificial Sequence: Synthetic peptide
DNYKRAS

SEQ ID NO: 544 - protein, 7 aa, Artificial Sequence
  Description of Artificial Sequence: Synthetic peptide
DNIKRPS

SEQ ID NO: 545 - protein, 7 aa, Artificial Sequence
  Description of Artificial Sequence: Synthetic peptide
DTHKRPS

SEQ ID NO: 546 - protein, 7 aa, Artificial Sequence
  Description of Artificial Sequence: Synthetic peptide
DTNRRPS

SEQ ID NO: 547 - protein, 7 aa, Artificial Sequence
  Description of Artificial Sequence: Synthetic peptide
DTNQRPS

SEQ ID NO: 548 - protein, 7 aa, Artificial Sequence
  Description of Artificial Sequence: Synthetic peptide
ESDKRPS

SEQ ID NO: 549 - protein, 7 aa, Artificial Sequence
  Description of Artificial Sequence: Synthetic peptide
DNDKRSS

SEQ ID NO: 550 - protein, 7 aa, Artificial Sequence
  Description of Artificial Sequence: Synthetic peptide
GSNKRPS

SEQ ID NO: 551 - protein, 7 aa, Artificial Sequence
  Description of Artificial Sequence: Synthetic peptide
DNNKRVS

SEQ ID NO: 552 - protein, 7 aa, Artificial Sequence
  Description of Artificial Sequence: Synthetic peptide
NNNRRPS

SEQ ID NO: 553 - protein, 7 aa, Artificial Sequence
  Description of Artificial Sequence: Synthetic peptide
DNFKRPS

SEQ ID NO: 554 - protein, 7 aa, Artificial Sequence
  Description of Artificial Sequence: Synthetic peptide
ENDKRPS

SEQ ID NO: 555 - protein, 7 aa, Artificial Sequence
  Description of Artificial Sequence: Synthetic peptide
ENNKRLS

SEQ ID NO: 556 - protein, 7 aa, Artificial Sequence
  Description of Artificial Sequence: Synthetic peptide
ADNKRPS

SEQ ID NO: 557 - protein, 7 aa, Artificial Sequence
  Description of Artificial Sequence: Synthetic peptide
EDNERPS

SEQ ID NO: 558 - protein, 7 aa, Artificial Sequence
  Description of Artificial Sequence: Synthetic peptide
DTDQRPS

SEQ ID NO: 559 - protein, 7 aa, Artificial Sequence
  Description of Artificial Sequence: Synthetic peptide
DNYQRPS

SEQ ID NO: 560 - protein, 7 aa, Artificial Sequence
  Description of Artificial Sequence: Synthetic peptide
DENKRPS

SEQ ID NO: 561 - protein, 7 aa, Artificial Sequence
  Description of Artificial Sequence: Synthetic peptide
DTNKRPS

SEQ ID NO: 562 - protein, 7 aa, Artificial Sequence
  Description of Artificial Sequence: Synthetic peptide
DDYRRPS

SEQ ID NO: 563 - protein, 7 aa, Artificial Sequence
  Description of Artificial Sequence: Synthetic peptide
DNDKRHS

SEQ ID NO: 564 - protein, 7 aa, Artificial Sequence
  Description of Artificial Sequence: Synthetic peptide
ENDNRPS

SEQ ID NO: 565 - protein, 7 aa, Artificial Sequence
  Description of Artificial Sequence: Synthetic peptide
DDNERPS

SEQ ID NO: 566 - protein, 7 aa, Artificial Sequence
  Description of Artificial Sequence: Synthetic peptide
DNKKRPS

SEQ ID NO: 567 - protein, 7 aa, Artificial Sequence
  Description of Artificial Sequence: Synthetic peptide
DVDKRPS

SEQ ID NO: 568 - protein, 7 aa, Artificial Sequence
  Description of Artificial Sequence: Synthetic peptide
ENKKRPS

SEQ ID NO: 569 - protein, 7 aa, Artificial Sequence
  Description of Artificial Sequence: Synthetic peptide
VNDKRPS

SEQ ID NO: 570 - protein, 7 aa, Artificial Sequence
  Description of Artificial Sequence: Synthetic peptide
DNDHRPS

SEQ ID NO: 571 - protein, 7 aa, Artificial Sequence
  Description of Artificial Sequence: Synthetic peptide
DINKRPS

SEQ ID NO: 572 - protein, 7 aa, Artificial Sequence
  Description of Artificial Sequence: Synthetic peptide
ANNERPS

SEQ ID NO: 573 - protein, 7 aa, Artificial Sequence
  Description of Artificial Sequence: Synthetic peptide
DNENRPS

SEQ ID NO: 574 - protein, 7 aa, Artificial Sequence
  Description of Artificial Sequence: Synthetic peptide
GDDKRPS

SEQ ID NO: 575 - protein, 7 aa, Artificial Sequence
  Description of Artificial Sequence: Synthetic peptide
ANNQRPS

SEQ ID NO: 576 - protein, 7 aa, Artificial Sequence
  Description of Artificial Sequence: Synthetic peptide
DDDKRPS

SEQ ID NO: 577 - protein, 7 aa, Artificial Sequence
  Description of Artificial Sequence: Synthetic peptide
YNNKRPS

SEQ ID NO: 578 - protein, 7 aa, Artificial Sequence
  Description of Artificial Sequence: Synthetic peptide
EDDKRPS

SEQ ID NO: 579 - protein, 7 aa, Artificial Sequence
  Description of Artificial Sequence: Synthetic peptide
ENNNRPS

SEQ ID NO: 580 - protein, 7 aa, Artificial Sequence
  Description of Artificial Sequence: Synthetic peptide
DNNLRPS

SEQ ID NO: 581 - protein, 7 aa, Artificial Sequence
  Description of Artificial Sequence: Synthetic peptide
ESNKRPS

SEQ ID NO: 582 - protein, 7 aa, Artificial Sequence
  Description of Artificial Sequence: Synthetic peptide
DTDKRPS

SEQ ID NO: 583 - protein, 7 aa, Artificial Sequence
  Description of Artificial Sequence: Synthetic peptide
DDDQRPS

SEQ ID NO: 584 - protein, 7 aa, Artificial Sequence
  Description of Artificial Sequence: Synthetic peptide
VNNKRPS

SEQ ID NO: 585 - protein, 7 aa, Artificial Sequence
  Description of Artificial Sequence: Synthetic peptide
DDYKRPS

SEQ ID NO: 586 - protein, 7 aa, Artificial Sequence
  Description of Artificial Sequence: Synthetic peptide
DNTKRPS

SEQ ID NO: 587 - protein, 7 aa, Artificial Sequence
  Description of Artificial Sequence: Synthetic peptide
DDTERPS

SEQ ID NO: 588 - protein, 7 aa, Artificial Sequence
  Description of Artificial Sequence: Synthetic peptide
GNDKRPS

SEQ ID NO: 589 - protein, 7 aa, Artificial Sequence
  Description of Artificial Sequence: Synthetic peptide
DNEKRPS

SEQ ID NO: 590 - protein, 7 aa, Artificial Sequence
  Description of Artificial Sequence: Synthetic peptide
DNDDRPS

SEQ ID NO: 591 - protein, 7 aa, Artificial Sequence
  Description of Artificial Sequence: Synthetic peptide
DDNRRPS

SEQ ID NO: 592 - protein, 7 aa, Artificial Sequence
  Description of Artificial Sequence: Synthetic peptide
GNNKRPS

SEQ ID NO: 593 - protein, 7 aa, Artificial Sequence
  Description of Artificial Sequence: Synthetic peptide
ANDKRPS

SEQ ID NO: 594 - protein, 7 aa, Artificial Sequence
  Description of Artificial Sequence: Synthetic peptide
DNNKRHS

SEQ ID NO: 595 - protein, 7 aa, Artificial Sequence
  Description of Artificial Sequence: Synthetic peptide
DDNQRPS

SEQ ID NO: 596 - protein, 7 aa, Artificial Sequence
  Description of Artificial Sequence: Synthetic peptide
GNDRRPS

SEQ ID NO: 597 - protein, 7 aa, Artificial Sequence
  Description of Artificial Sequence: Synthetic peptide
DNHNRPS

SEQ ID NO: 598 - protein, 7 aa, Artificial Sequence
  Description of Artificial Sequence: Synthetic peptide
DNYERPS

SEQ ID NO: 599 - protein, 7 aa, Artificial Sequence
  Description of Artificial Sequence: Synthetic peptide
ENNKRSS

SEQ ID NO: 600 - protein, 7 aa, Artificial Sequence
  Description of Artificial Sequence: Synthetic peptide
DDHKRPS

SEQ ID NO: 601 - protein, 7 aa, Artificial Sequence
  Description of Artificial Sequence: Synthetic peptide
DNNKRRS

SEQ ID NO: 602 - protein, 7 aa, Artificial Sequence
  Description of Artificial Sequence: Synthetic peptide
DNDKRPS

SEQ ID NO: 603 - protein, 7 aa, Artificial Sequence
  Description of Artificial Sequence: Synthetic peptide
DKNKRPS

SEQ ID NO: 604 - protein, 7 aa, Artificial Sequence
  Description of Artificial Sequence: Synthetic peptide
DNNKRPS

SEQ ID NO: 605 - protein, 7 aa, Artificial Sequence
  Description of Artificial Sequence: Synthetic peptide
DIDKRPS

SEQ ID NO: 606 - protein, 7 aa, Artificial Sequence
  Description of Artificial Sequence: Synthetic peptide
DDKKRPS

SEQ ID NO: 607 - protein, 7 aa, Artificial Sequence
  Description of Artificial Sequence: Synthetic peptide
ANNKRPS

SEQ ID NO: 608 - protein, 7 aa, Artificial Sequence
  Description of Artificial Sequence: Synthetic peptide
DNDKGPS

SEQ ID NO: 609 - protein, 7 aa, Artificial Sequence
  Description of Artificial Sequence: Synthetic peptide
EDNRRPS

SEQ ID NO: 610 - protein, 7 aa, Artificial Sequence
  Description of Artificial Sequence: Synthetic peptide
ENNKRPS

SEQ ID NO: 611 - protein, 7 aa, Artificial Sequence
  Description of Artificial Sequence: Synthetic peptide
NNNKRPS

SEQ ID NO: 612 - protein, 7 aa, Artificial Sequence
  Description of Artificial Sequence: Synthetic peptide
DNNERPS

SEQ ID NO: 613 - protein, 7 aa, Artificial Sequence
  Description of Artificial Sequence: Synthetic peptide
DNIQRPS

SEQ ID NO: 614 - protein, 7 aa, Artificial Sequence
  Description of Artificial Sequence: Synthetic peptide
DNNYRPS

SEQ ID NO: 615 - protein, 7 aa, Artificial Sequence
  Description of Artificial Sequence: Synthetic peptide
DNYNRPS

SEQ ID NO: 616 - DNA, 21 bp, Artificial Sequence
  Description of Artificial Sequence: Synthetic oligonucleotide
gacaataataagcgaccccca

SEQ ID NO: 617 - DNA, 21 bp, Artificial Sequence
  Description of Artificial Sequence: Synthetic oligonucleotide
gagaataataggcgaccctca

SEQ ID NO: 618 - DNA, 21 bp, Artificial Sequence
  Description of Artificial Sequence: Synthetic oligonucleotide
gacaataataagcaaccctca

SEQ ID NO: 619 - DNA, 21 bp, Artificial Sequence
  Description of Artificial Sequence: Synthetic oligonucleotide
gacaataacaagcgacccttg

SEQ ID NO: 620 - DNA, 21 bp, Artificial Sequence
  Description of Artificial Sequence: Synthetic oligonucleotide
gacaatgataagcgacccgca

SEQ ID NO: 621 - DNA, 21 bp, Artificial Sequence
  Description of Artificial Sequence: Synthetic oligonucleotide
gacaatcatgagcgaccctca

SEQ ID NO: 622 - DNA, 21 bp, Artificial Sequence
  Description of Artificial Sequence: Synthetic oligonucleotide
gaaaaccgtaagcgaccctca

SEQ ID NO: 623 - DNA, 21 bp, Artificial Sequence
  Description of Artificial Sequence: Synthetic oligonucleotide
gacaatgatcagcgaccctca

SEQ ID NO: 624 - DNA, 21 bp, Artificial Sequence
  Description of Artificial Sequence: Synthetic oligonucleotide
gagaattataagcgaccctca

SEQ ID NO: 625 - DNA, 21 bp, Artificial Sequence
  Description of Artificial Sequence: Synthetic oligonucleotide
gaaaatactaagcgaccctca

SEQ ID NO: 626 - DNA, 21 bp, Artificial Sequence
  Description of Artificial Sequence: Synthetic oligonucleotide
gacactgagaagaggccctca

SEQ ID NO: 627 - DNA, 21 bp, Artificial Sequence
  Description of Artificial Sequence: Synthetic oligonucleotide
gacaatgataagcgaccccca

SEQ ID NO: 628 - DNA, 21 bp, Artificial Sequence
  Description of Artificial Sequence: Synthetic oligonucleotide
gaccataataagcgaccctca

SEQ ID NO: 629 - DNA, 21 bp, Artificial Sequence
  Description of Artificial Sequence: Synthetic oligonucleotide
ggcaataatgagcgaccctca

SEQ ID NO: 630 - DNA, 21 bp, Artificial Sequence
  Description of Artificial Sequence: Synthetic oligonucleotide
gacactagtaagcgaccctca

SEQ ID NO: 631 - DNA, 21 bp, Artificial Sequence
  Description of Artificial Sequence: Synthetic oligonucleotide
gaatataataagcgcccctca

SEQ ID NO: 632 - DNA, 21 bp, Artificial Sequence
  Description of Artificial Sequence: Synthetic oligonucleotide
gaaaatattaagcgaccctca

SEQ ID NO: 633 - DNA, 21 bp, Artificial Sequence
  Description of Artificial Sequence: Synthetic oligonucleotide
gacaatgttaagcgaccctca

SEQ ID NO: 634 - DNA, 21 bp, Artificial Sequence
  Description of Artificial Sequence: Synthetic oligonucleotide
gaaaacgataaacgatcctca

SEQ ID NO: 635 - DNA, 21 bp, Artificial Sequence
  Description of Artificial Sequence: Synthetic oligonucleotide
gaaaataataagcgacactca

SEQ ID NO: 636 - DNA, 21 bp, Artificial Sequence
  Description of Artificial Sequence: Synthetic oligonucleotide
ggaaatgatcagcgaccctca

SEQ ID NO: 637 - DNA, 21 bp, Artificial Sequence
  Description of Artificial Sequence: Synthetic oligonucleotide
gacaatgataggcgaccctca

SEQ ID NO: 638 - DNA, 21 bp, Artificial Sequence
  Description of Artificial Sequence: Synthetic oligonucleotide
gacaatcataagcggccctca

SEQ ID NO: 639 - DNA, 21 bp, Artificial Sequence
  Description of Artificial Sequence: Synthetic oligonucleotide
gacaataatgaccgaccctca

SEQ ID NO: 640 - DNA, 21 bp, Artificial Sequence
  Description of Artificial Sequence: Synthetic oligonucleotide
gagaataatcagcgaccctca

SEQ ID NO: 641 - DNA, 21 bp, Artificial Sequence
  Description of Artificial Sequence: Synthetic oligonucleotide
gacaataatcagcgaccctca

SEQ ID NO: 642 - DNA, 21 bp, Artificial Sequence
  Description of Artificial Sequence: Synthetic oligonucleotide
gagaatgttaagcgaccctca

SEQ ID NO: 643 - DNA, 21 bp, Artificial Sequence
  Description of Artificial Sequence: Synthetic oligonucleotide
gacacttataagagaccctca

SEQ ID NO: 644 - DNA, 21 bp, Artificial Sequence
  Description of Artificial Sequence: Synthetic oligonucleotide
aacaataataaccgaccctca

SEQ ID NO: 645 - DNA, 21 bp, Artificial Sequence
  Description of Artificial Sequence: Synthetic oligonucleotide
ggcaataataatcgaccctca

SEQ ID NO: 646 - DNA, 21 bp, Artificial Sequence
  Description of Artificial Sequence: Synthetic oligonucleotide
gaaaatgatcagcgaccctca

SEQ ID NO: 647 - DNA, 21 bp, Artificial Sequence
  Description of Artificial Sequence: Synthetic oligonucleotide
gacaataataagcgagcctca

SEQ ID NO: 648 - DNA, 21 bp, Artificial Sequence
  Description of Artificial Sequence: Synthetic oligonucleotide
gacaatgataagcgaccctta

SEQ ID NO: 649 - DNA, 21 bp, Artificial Sequence
  Description of Artificial Sequence: Synthetic oligonucleotide
gacactgatgagcgaccttca

SEQ ID NO: 650 - DNA, 21 bp, Artificial Sequence
  Description of Artificial Sequence: Synthetic oligonucleotide
gacaataggaagcgaccctca

SEQ ID NO: 651 - DNA, 21 bp, Artificial Sequence
  Description of Artificial Sequence: Synthetic oligonucleotide
gacaatgatgctcgaccctca

SEQ ID NO: 652 - DNA, 21 bp, Artificial Sequence
  Description of Artificial Sequence: Synthetic oligonucleotide
gacaataataagcgactctca

SEQ ID NO: 653 - DNA, 21 bp, Artificial Sequence
  Description of Artificial Sequence: Synthetic oligonucleotide
gacaatgataagcgagcctca

SEQ ID NO: 654 - DNA, 21 bp, Artificial Sequence
  Description of Artificial Sequence: Synthetic oligonucleotide
gacaatactgagcgaccctca

SEQ ID NO: 655 - DNA, 21 bp, Artificial Sequence
  Description of Artificial Sequence: Synthetic oligonucleotide
gacaataatattcgaccctca

SEQ ID NO: 656 - DNA, 21 bp, Artificial Sequence
  Description of Artificial Sequence: Synthetic oligonucleotide
gacaataagaggcgaccctca

SEQ ID NO: 657 - DNA, 21 bp, Artificial Sequence
  Description of Artificial Sequence: Synthetic oligonucleotide
gacgataataaccgaccctca

SEQ ID NO: 658 - DNA, 21 bp, Artificial Sequence
  Description of Artificial Sequence: Synthetic oligonucleotide
gcgaataatcgacgaccctca

SEQ ID NO: 659 - DNA, 21 bp, Artificial Sequence
  Description of Artificial Sequence: Synthetic oligonucleotide
gacaatgataagcgactgtca

SEQ ID NO: 660 - DNA, 21 bp, Artificial Sequence
  Description of Artificial Sequence: Synthetic oligonucleotide
gacaataataagcgacccgca

SEQ ID NO: 661 - DNA, 21 bp, Artificial Sequence
  Description of Artificial Sequence: Synthetic oligonucleotide
gacaattatagacgtccctca

SEQ ID NO: 662 - DNA, 21 bp, Artificial Sequence
  Description of Artificial Sequence: Synthetic oligonucleotide
gccaatgatcagcgaccctca

SEQ ID NO: 663 - DNA, 21 bp, Artificial Sequence
  Description of Artificial Sequence: Synthetic oligonucleotide
gacaatgataagcgacgctca

SEQ ID NO: 664 - DNA, 21 bp, Artificial Sequence
  Description of Artificial Sequence: Synthetic oligonucleotide
gacaagaatgagcgaccctca

SEQ ID NO: 665 - DNA, 21 bp, Artificial Sequence
  Description of Artificial Sequence: Synthetic oligonucleotide
gacaataaggagcgaccctca

SEQ ID NO: 666 - DNA, 21 bp, Artificial Sequence
  Description of Artificial Sequence: Synthetic oligonucleotide
gacaataataagggaccctca

SEQ ID NO: 667 - DNA, 21 bp, Artificial Sequence
  Description of Artificial Sequence: Synthetic oligonucleotide
gaaaatgatagacgaccctca

SEQ ID NO: 668 - DNA, 21 bp, Artificial Sequence
  Description of Artificial Sequence: Synthetic oligonucleotide
gaaaatgatgagcgaccctca

SEQ ID NO: 669 - DNA, 21 bp, Artificial Sequence
  Description of Artificial Sequence: Synthetic oligonucleotide
caaaataataagcgaccctca

SEQ ID NO: 670 - DNA, 21 bp, Artificial Sequence
  Description of Artificial Sequence: Synthetic oligonucleotide
gacaatcgtgagcgaccctca

SEQ ID NO: 671 - DNA, 21 bp, Artificial Sequence
  Description of Artificial Sequence: Synthetic oligonucleotide
gacaataatagacgaccctca

SEQ ID NO: 672 - DNA, 21 bp, Artificial Sequence
  Description of Artificial Sequence: Synthetic oligonucleotide
ggaaataataggcgaccctca

SEQ ID NO: 673 - DNA, 21 bp, Artificial Sequence
  Description of Artificial Sequence: Synthetic oligonucleotide
gacaatgataaccgaccctca

SEQ ID NO: 674 - DNA, 21 bp, Artificial Sequence
  Description of Artificial Sequence: Synthetic oligonucleotide
gaagataataagcgaccctca

SEQ ID NO: 675 - DNA, 21 bp, Artificial Sequence
  Description of Artificial Sequence: Synthetic oligonucleotide
gacgatgatgagcggccctca

SEQ ID NO: 676 - DNA, 21 bp, Artificial Sequence
  Description of Artificial Sequence: Synthetic oligonucleotide
gcaagtaataagcgaccctca

SEQ ID NO: 677 - DNA, 21 bp, Artificial Sequence
  Description of Artificial Sequence: Synthetic oligonucleotide
gacaataataagcgatcctca

SEQ ID NO: 678 - DNA, 21 bp, Artificial Sequence
  Description of Artificial Sequence: Synthetic oligonucleotide
caaaataatgagcgaccctca

SEQ ID NO: 679 - DNA, 21 bp, Artificial Sequence
  Description of Artificial Sequence: Synthetic oligonucleotide
gacgatgataggcgaccctca

SEQ ID NO: 680 - DNA, 21 bp, Artificial Sequence
  Description of Artificial Sequence: Synthetic oligonucleotide
aacaatgataagcgaccctca

SEQ ID NO: 681 - DNA, 21 bp, Artificial Sequence
  Description of Artificial Sequence: Synthetic oligonucleotide
gacaataataaccgaccctca

SEQ ID NO: 682 - DNA, 21 bp, Artificial Sequence
  Description of Artificial Sequence: Synthetic oligonucleotide
gacaataatgtgcgaccctca

SEQ ID NO: 683 - DNA, 21 bp, Artificial Sequence
  Description of Artificial Sequence: Synthetic oligonucleotide
gaaaataatgagcgaccctca

SEQ ID NO: 684 - DNA, 21 bp, Artificial Sequence
  Description of Artificial Sequence: Synthetic oligonucleotide
gacaataatcaccgaccctca

SEQ ID NO: 685 - DNA, 21 bp, Artificial Sequence
  Description of Artificial Sequence: Synthetic oligonucleotide
gacaatgatgagcgcccctcg

SEQ ID NO: 686 - DNA, 21 bp, Artificial Sequence
  Description of Artificial Sequence: Synthetic oligonucleotide
gacaatatccggcgaccctca

SEQ ID NO: 687 - DNA, 21 bp, Artificial Sequence
  Description of Artificial Sequence: Synthetic oligonucleotide
gactttaataagcgaccctca

SEQ ID NO: 688 - DNA, 21 bp, Artificial Sequence
  Description of Artificial Sequence: Synthetic oligonucleotide
gaaactaataagcgaccctca

SEQ ID NO: 689 - DNA, 21 bp, Artificial Sequence
  Description of Artificial Sequence: Synthetic oligonucleotide
aacgataataagcgaccctca

SEQ ID NO: 690 - DNA, 21 bp, Artificial Sequence
  Description of Artificial Sequence: Synthetic oligonucleotide
gacgataataagcgaccctca

SEQ ID NO: 691 - DNA, 21 bp, Artificial Sequence
  Description of Artificial Sequence: Synthetic oligonucleotide
gacaattataagcgaccctca

SEQ ID NO: 692 - DNA, 21 bp, Artificial Sequence
  Description of Artificial Sequence: Synthetic oligonucleotide
cacaataataagcgaccctca

SEQ ID NO: 693 - DNA, 21 bp, Artificial Sequence
  Description of Artificial Sequence: Synthetic oligonucleotide
gacaatcatcagcgaccctca

SEQ ID NO: 694 - DNA, 21 bp, Artificial Sequence
  Description of Artificial Sequence: Synthetic oligonucleotide
gacaattataagcgagcctca

SEQ ID NO: 695 - DNA, 21 bp, Artificial Sequence
  Description of Artificial Sequence: Synthetic oligonucleotide
gacaatattaagcgaccctca

SEQ ID NO: 696 - DNA, 21 bp, Artificial Sequence
  Description of Artificial Sequence: Synthetic oligonucleotide
gacactcataagcgaccctca

SEQ ID NO: 697 - DNA, 21 bp, Artificial Sequence
  Description of Artificial Sequence: Synthetic oligonucleotide
gacactaataggcgaccctct

SEQ ID NO: 698 - DNA, 21 bp, Artificial Sequence
  Description of Artificial Sequence: Synthetic oligonucleotide
gacactaatcagcgaccctca

SEQ ID NO: 699 - DNA, 21 bp, Artificial Sequence
  Description of Artificial Sequence: Synthetic oligonucleotide
gaaagtgataagcgaccctca

SEQ ID NO: 700 - DNA, 21 bp, Artificial Sequence
  Description of Artificial Sequence: Synthetic oligonucleotide
gacaatgataagcgatcttcg

SEQ ID NO: 701 - DNA, 21 bp, Artificial Sequence
  Description of Artificial Sequence: Synthetic oligonucleotide
ggcagtaataagcgaccctca

SEQ ID NO: 702 - DNA, 21 bp, Artificial Sequence
  Description of Artificial Sequence: Synthetic oligonucleotide
gacaataacaagcgagtttca

SEQ ID NO: 703 - DNA, 21 bp, Artificial Sequence
  Description of Artificial Sequence: Synthetic oligonucleotide
aacaataataggcgaccctca

SEQ ID NO: 704 - DNA, 21 bp, Artificial Sequence
  Description of Artificial Sequence: Synthetic oligonucleotide
gacaattttaagcgaccctca

SEQ ID NO: 705 - DNA, 21 bp, Artificial Sequence
  Description of Artificial Sequence: Synthetic oligonucleotide
gaaaatgataaacgaccctca

SEQ ID NO: 706 - DNA, 21 bp, Artificial Sequence
  Description of Artificial Sequence: Synthetic oligonucleotide
gaaaataataagcgactctca

SEQ ID NO: 707 - DNA, 21 bp, Artificial Sequence
  Description of Artificial Sequence: Synthetic oligonucleotide
gcagataataagcgaccctca

SEQ ID NO: 708 - DNA, 21 bp, Artificial Sequence
  Description of Artificial Sequence: Synthetic oligonucleotide
gaagataatgagcgcccctca

SEQ ID NO: 709 - DNA, 21 bp, Artificial Sequence
  Description of Artificial Sequence: Synthetic oligonucleotide
gacactgatcagcgaccctca

SEQ ID NO: 710 - DNA, 21 bp, Artificial Sequence
  Description of Artificial Sequence: Synthetic oligonucleotide
gacaattatcagcgaccctca

SEQ ID NO: 711 - DNA, 21 bp, Artificial Sequence
  Description of Artificial Sequence: Synthetic oligonucleotide
gacgagaataagcgaccctca

SEQ ID NO: 712 - DNA, 21 bp, Artificial Sequence
  Description of Artificial Sequence: Synthetic oligonucleotide
gacactaataagcgaccctca

SEQ ID NO: 713 - DNA, 21 bp, Artificial Sequence
  Description of Artificial Sequence: Synthetic oligonucleotide
gacgattatcggcgaccctca

SEQ ID NO: 714 - DNA, 21 bp, Artificial Sequence
  Description of Artificial Sequence: Synthetic oligonucleotide
gacaacgataagcggcactca

SEQ ID NO: 715 - DNA, 21 bp, Artificial Sequence
  Description of Artificial Sequence: Synthetic oligonucleotide
gaaaatgataatcgaccctca

SEQ ID NO: 716 - DNA, 21 bp, Artificial Sequence
  Description of Artificial Sequence: Synthetic oligonucleotide
gacgataatgagcgcccctca

SEQ ID NO: 717 - DNA, 21 bp, Artificial Sequence
  Description of Artificial Sequence: Synthetic oligonucleotide
gacaataagaagcgaccctca

SEQ ID NO: 718 - DNA, 21 bp, Artificial Sequence
  Description of Artificial Sequence: Synthetic oligonucleotide
gacgttgataagcgaccctca

SEQ ID NO: 719 - DNA, 21 bp, Artificial Sequence
  Description of Artificial Sequence: Synthetic oligonucleotide
gaaaataaaaaacgaccctct

SEQ ID NO: 720 - DNA, 21 bp, Artificial Sequence
  Description of Artificial Sequence: Synthetic oligonucleotide
gtcaatgataagcgaccctca

SEQ ID NO: 721 - DNA, 21 bp, Artificial Sequence
  Description of Artificial Sequence: Synthetic oligonucleotide
gacaatgatcaccgaccctca

SEQ ID NO: 722 - DNA, 21 bp, Artificial Sequence
  Description of Artificial Sequence: Synthetic oligonucleotide
gacattaataagcgaccctca

SEQ ID NO: 723 - DNA, 21 bp, Artificial Sequence
  Description of Artificial Sequence: Synthetic oligonucleotide
gccaataatgagcgaccctca

SEQ ID NO: 724 - DNA, 21 bp, Artificial Sequence
  Description of Artificial Sequence: Synthetic oligonucleotide
gacaatgaaaaccgaccgtca

SEQ ID NO: 725 - DNA, 21 bp, Artificial Sequence
  Description of Artificial Sequence: Synthetic oligonucleotide
ggcgatgataagcgaccctca

SEQ ID NO: 726 - DNA, 21 bp, Artificial Sequence
  Description of Artificial Sequence: Synthetic oligonucleotide
gccaataatcagcgaccttca

SEQ ID NO: 727 - DNA, 21 bp, Artificial Sequence
  Description of Artificial Sequence: Synthetic oligonucleotide
gacgatgataagcgaccctca

SEQ ID NO: 728 - DNA, 21 bp, Artificial Sequence
  Description of Artificial Sequence: Synthetic oligonucleotide
tacaataataagcggccctca

SEQ ID NO: 729 - DNA, 21 bp, Artificial Sequence
  Description of Artificial Sequence: Synthetic oligonucleotide
gaagatgataagcgaccctca

SEQ ID NO: 730 - DNA, 21 bp, Artificial Sequence
  Description of Artificial Sequence: Synthetic oligonucleotide
gaaaacaataaccgaccctcg

SEQ ID NO: 731 - DNA, 21 bp, Artificial Sequence
  Description of Artificial Sequence: Synthetic oligonucleotide
gacaataatctgcgaccctca

SEQ ID NO: 732 - DNA, 21 bp, Artificial Sequence
  Description of Artificial Sequence: Synthetic oligonucleotide
gagagtaacaagcgaccctca

SEQ ID NO: 733 - DNA, 21 bp, Artificial Sequence
  Description of Artificial Sequence: Synthetic oligonucleotide
gacactgataagcggccctca

SEQ ID NO: 734 - DNA, 21 bp, Artificial Sequence
  Description of Artificial Sequence: Synthetic oligonucleotide
gacgatgatcagcgaccctca

SEQ ID NO: 735 - DNA, 21 bp, Artificial Sequence
  Description of Artificial Sequence: Synthetic oligonucleotide
gtgaataataagagaccctcc

SEQ ID NO: 736 - DNA, 21 bp, Artificial Sequence
  Description of Artificial Sequence: Synthetic oligonucleotide
gacgattataagcgaccctca

SEQ ID NO: 737 - DNA, 21 bp, Artificial Sequence
  Description of Artificial Sequence: Synthetic oligonucleotide
gacaatactaagcgaccctca

SEQ ID NO: 738 - DNA, 21 bp, Artificial Sequence
  Description of Artificial Sequence: Synthetic oligonucleotide
gacgatactgagcgaccctca

SEQ ID NO: 739 - DNA, 21 bp, Artificial Sequence
  Description of Artificial Sequence: Synthetic oligonucleotide
ggcaatgataagcgaccctca

SEQ ID NO: 740 - DNA, 21 bp, Artificial Sequence
  Description of Artificial Sequence: Synthetic oligonucleotide
gacaatgaaaagcgaccctca

SEQ ID NO: 741 - DNA, 21 bp, Artificial Sequence
  Description of Artificial Sequence: Synthetic oligonucleotide
gacaatgatgaccgaccctca

SEQ ID NO: 742 - DNA, 21 bp, Artificial Sequence
  Description of Artificial Sequence: Synthetic oligonucleotide
gacgataataggcgtccctca

SEQ ID NO: 743 - DNA, 21 bp, Artificial Sequence
  Description of Artificial Sequence: Synthetic oligonucleotide
ggcaataataagcgaccctca

SEQ ID NO: 744 - DNA, 21 bp, Artificial Sequence
  Description of Artificial Sequence: Synthetic oligonucleotide
gccaatgataagcgaccctca

SEQ ID NO: 745 - DNA, 21 bp, Artificial Sequence
  Description of Artificial Sequence: Synthetic oligonucleotide
gacaataataagcgacactca

SEQ ID NO: 746 - DNA, 21 bp, Artificial Sequence
  Description of Artificial Sequence: Synthetic oligonucleotide
gacgacaatcagcgaccctca

SEQ ID NO: 747 - DNA, 21 bp, Artificial Sequence
  Description of Artificial Sequence: Synthetic oligonucleotide
ggcaatgataggcgaccctca

SEQ ID NO: 748 - DNA, 21 bp, Artificial Sequence
  Description of Artificial Sequence: Synthetic oligonucleotide
gacaatcataaccgaccctca

SEQ ID NO: 749 - DNA, 21 bp, Artificial Sequence
  Description of Artificial Sequence: Synthetic oligonucleotide
gacaattatgagcgaccctca

SEQ ID NO: 750 - DNA, 21 bp, Artificial Sequence
  Description of Artificial Sequence: Synthetic oligonucleotide
gaaaataataagcgatcctca

SEQ ID NO: 751 - DNA, 21 bp, Artificial Sequence
  Description of Artificial Sequence: Synthetic oligonucleotide
gacgatcataagcggccctca

SEQ ID NO: 752 - DNA, 21 bp, Artificial Sequence
  Description of Artificial Sequence: Synthetic oligonucleotide
gacaataataaacgacgttca

SEQ ID NO: 753 - DNA, 21 bp, Artificial Sequence
  Description of Artificial Sequence: Synthetic oligonucleotide
gacaatgataagcgaccgtca

SEQ ID NO: 754 - DNA, 21 bp, Artificial Sequence
  Description of Artificial Sequence: Synthetic oligonucleotide
gacaagaataagcgaccctca

SEQ ID NO: 755 - DNA, 21 bp, Artificial Sequence
  Description of Artificial Sequence: Synthetic oligonucleotide
gacaataataagcgaccctca

SEQ ID NO: 756 - DNA, 21 bp, Artificial Sequence
  Description of Artificial Sequence: Synthetic oligonucleotide
gacattgataagcgaccctca

SEQ ID NO: 757 - DNA, 21 bp, Artificial Sequence
  Description of Artificial Sequence: Synthetic oligonucleotide
gacgataagaagcgaccctca

SEQ ID NO: 758 - DNA, 21 bp, Artificial Sequence
  Description of Artificial Sequence: Synthetic oligonucleotide
gccaataataagcgaccctca

SEQ ID NO: 759 - DNA, 21 bp, Artificial Sequence
  Description of Artificial Sequence: Synthetic oligonucleotide
gacaatgataagggaccctca

SEQ ID NO: 760 - DNA, 21 bp, Artificial Sequence
  Description of Artificial Sequence: Synthetic oligonucleotide
gaagataataggcgaccctca

SEQ ID NO: 761 - DNA, 21 bp, Artificial Sequence
  Description of Artificial Sequence: Synthetic oligonucleotide
gagaataataagcgaccctca

SEQ ID NO: 762 - DNA, 21 bp, Artificial Sequence
  Description of Artificial Sequence: Synthetic oligonucleotide
aacaataataagcgaccctca

SEQ ID NO: 763 - DNA, 21 bp, Artificial Sequence
  Description of Artificial Sequence: Synthetic oligonucleotide
gacaataatgagcgaccctca

SEQ ID NO: 764 - DNA, 21 bp, Artificial Sequence
  Description of Artificial Sequence: Synthetic oligonucleotide
gacaatattcagcgaccctca

SEQ ID NO: 765 - DNA, 21 bp, Artificial Sequence
  Description of Artificial Sequence: Synthetic oligonucleotide
gacaataattaccgaccctca

SEQ ID NO: 766 - DNA, 21 bp, Artificial Sequence
  Description of Artificial Sequence: Synthetic oligonucleotide
gacaattataaccgaccctca

SEQ ID NO: 767 - protein, 13 aa, Artificial Sequence [sequence omitted]

SEQ ID NO: 768 - protein, 13 aa, Artificial Sequence [sequence omitted]

SEQ ID NO: 769 - protein, 13 aa, Artificial Sequence [sequence omitted]

SEQ ID NO: 770 - protein, 13 aa, Artificial Sequence [sequence omitted]

SEQ ID NO: 771 - protein, 13 aa, Artificial Sequence [sequence omitted]

SEQ ID NO: 772 - protein, 13 aa, Artificial Sequence [sequence omitted]

SEQ ID NO: 773 - protein, 13 aa, Artificial Sequence [sequence omitted]

SEQ ID NO: 774 - protein, 13 aa, Artificial Sequence
  Description of Artificial Sequence: Synthetic peptide
CGTWDRSLSVWVF

SEQ ID NO: 775 - protein, 13 aa, Artificial Sequence [sequence omitted]

SEQ ID NO: 776 - protein, 13 aa, Artificial Sequence [sequence omitted]

SEQ ID NO: 777 - protein, 13 aa, Artificial Sequence [sequence omitted]

SEQ ID NO: 778 - protein, 13 aa, Artificial Sequence [sequence omitted]

SEQ ID NO: 779 - protein, 13 aa, Artificial Sequence [sequence omitted]

SEQ ID NO: 780 - protein, 13 aa, Artificial Sequence
  Description of Artificial Sequence: Synthetic peptide
CGTWESSLSAWVF

SEQ ID NO: 781 - protein, 13 aa, Artificial Sequence
  Description of Artificial Sequence: Synthetic peptide
CGTWDTTLSAGVF

SEQ ID NO: 782 - protein, 13 aa, Artificial Sequence [sequence omitted]

SEQ ID NO: 783 - protein, 13 aa, Artificial Sequence [sequence omitted]

SEQ ID NO: 784 - protein, 13 aa, Artificial Sequence
  Description of Artificial Sequence: Synthetic peptide
CGTWDTSLSTGVF

SEQ ID NO: 785 - protein, 13 aa, Artificial Sequence [sequence omitted]

SEQ ID NO: 786 - protein, 13 aa, Artificial Sequence [sequence omitted]

SEQ ID NO: 787 - protein, 13 aa, Artificial Sequence
  Description of Artificial Sequence: Synthetic peptide
CGTWDTSLSAEVF

SEQ ID NO: 788 - protein, 13 aa, Artificial Sequence [sequence omitted]

SEQ ID NO: 789 - protein, 13 aa, Artificial Sequence [sequence omitted]

SEQ ID NO: 790 - protein, 13 aa, Artificial Sequence [sequence omitted]

SEQ ID NO: 791 - protein, 13 aa, Artificial Sequence
  Description of Artificial Sequence: Synthetic peptide
CGTWDNTLSAWVF

SEQ ID NO: 792 - protein, 13 aa, Artificial Sequence [sequence omitted]

SEQ ID NO: 793 - protein, 13 aa, Artificial Sequence [sequence omitted]

SEQ ID NO: 794 - protein, 13 aa, Artificial Sequence
  Description of Artificial Sequence: Synthetic peptide
CGTWHSSLSAGVF

SEQ ID NO: 795 - protein, 13 aa, Artificial Sequence
  Description of Artificial Sequence: Synthetic peptide
CGTWGSSLSAWVF

SEQ ID NO: 796 - protein, 13 aa, Artificial Sequence
  Description of Artificial Sequence: Synthetic peptide
CGTWESSLSGWVF

SEQ ID NO: 797 - protein, 13 aa, Artificial Sequence [sequence omitted]

SEQ ID NO: 798 - protein, 13 aa, Artificial Sequence [sequence omitted]

SEQ ID NO: 799 - protein, 13 aa, Artificial Sequence [sequence omitted]

SEQ ID NO: 800 - protein, 13 aa, Artificial Sequence
  Description of Artificial Sequence: Synthetic peptide
CGTWDVSLSVGVF

SEQ ID NO: 801 - protein, 13 aa, Artificial Sequence [sequence omitted]

SEQ ID NO: 802 - protein, 13 aa, Artificial Sequence
  Description of Artificial Sequence: Synthetic peptide
CGTWDTTLNIGVF

SEQ ID NO: 803 - protein, 13 aa, Artificial Sequence [sequence omitted]

SEQ ID NO: 804 - protein, 13 aa, Artificial Sequence
  Description of Artificial Sequence: Synthetic peptide
CGTWDTSLTAAVF

SEQ ID NO: 805 - protein, 13 aa, Artificial Sequence
  Description of Artificial Sequence: Synthetic peptide
CGTWDTSLSVGLF

SEQ ID NO: 806 - protein, 13 aa, Artificial Sequence
  Description of Artificial Sequence: Synthetic peptide
CGTWDTSLSGRVF

SEQ ID NO: 807 - protein, 13 aa, Artificial Sequence [sequence omitted]

SEQ ID NO: 808 - protein, 13 aa, Artificial Sequence [sequence omitted]

SEQ ID NO: 809 - protein, 14 aa, Artificial Sequence
  Description of Artificial Sequence: Synthetic peptide
CGTWDTSLSAGGVF

SEQ ID NO: 810 - protein, 13 aa, Artificial Sequence
  Description of Artificial Sequence: Synthetic peptide
CGTWDTSLRAYVF

SEQ ID NO: 811 - protein, 13 aa, Artificial Sequence
  Description of Artificial Sequence: Synthetic peptide
CGTWDTSLRAWVF

SEQ ID NO: 812 - protein, 13 aa, Artificial Sequence [sequence omitted]

SEQ ID NO: 813 - protein, 13 aa, Artificial Sequence
  Description of Artificial Sequence: Synthetic peptide
CGTWDTSLNIWVF

SEQ ID NO: 814 - protein, 13 aa, Artificial Sequence
  Description of Artificial Sequence: Synthetic peptide
CGTWDTSLNIGVF

SEQ ID NO: 815 - protein, 13 aa, Artificial Sequence
  Description of Artificial Sequence: Synthetic peptide
CGTWDTSLIAVVF

SEQ ID NO: 816 - protein, 13 aa, Artificial Sequence
  Description of Artificial Sequence: Synthetic peptide
CGTWDRSLSGWVF

SEQ ID NO: 817 - protein, 13 aa, Artificial Sequence
  Description of Artificial Sequence: Synthetic peptide
CGTWDNRLSGWVF

SEQ ID NO: 818 - protein, 13 aa, Artificial Sequence [sequence omitted]

SEQ ID NO: 819 - protein, 13 aa, Artificial Sequence
  Description of Artificial Sequence: Synthetic peptide
CGTWDKGLSAWVF

SEQ ID NO: 820 - protein, 13 aa, Artificial Sequence [sequence omitted]

SEQ ID NO: 821 - protein, 15 aa, Artificial Sequence
  Description of Artificial Sequence: Synthetic peptide
CGTWDESLSGGEVVF

SEQ ID NO: 822 - protein, 13 aa, Artificial Sequence [sequence omitted]

SEQ ID NO: 823 - protein, 13 aa, Artificial Sequence
  Description of Artificial Sequence: Synthetic peptide
CGTWDAGLSAWVF

SEQ ID NO: 824 - protein, 13 aa, Artificial Sequence
  Description of Artificial Sequence: Synthetic peptide
CGAWDTSLSAWVF

SEQ ID NO: 825 - protein, 13 aa, Artificial Sequence [sequence omitted]

SEQ ID NO: 826 - protein, 13 aa, Artificial Sequence
  Description of Artificial Sequence: Synthetic peptide
CGAWDTSLRAGVF

SEQ ID NO: 827 - protein, 13 aa, Artificial Sequence
  Description of Artificial Sequence: Synthetic peptide
CATWDTSVSAWVF

SEQ ID NO: 828 - protein, 13 aa, Artificial Sequence [sequence omitted]

SEQ ID NO: 829 - protein, 13 aa, Artificial Sequence
  Description of Artificial Sequence: Synthetic peptide
CATWDNTLSAGVF

SEQ ID NO: 830 - protein, 13 aa, Artificial Sequence
  Description of Artificial Sequence: Synthetic peptide
CAAWDRSLSVWVF

SEQ ID NO: 831 - protein, 13 aa, Artificial Sequence
  Description of Artificial Sequence: Synthetic peptide
CYTWHSSLRGGVF

SEQ ID NO: 832 - protein, 13 aa, Artificial Sequence
  Description of Artificial Sequence: Synthetic peptide
CVTWTSSPSAWVF

SEQ ID NO: 833 - protein, 11 aa, Artificial Sequence
  Description of Artificial Sequence: Synthetic peptide
CVTWRGGLVLF

SEQ ID NO: 834 - protein, 13 aa, Artificial Sequence
  Description of Artificial Sequence: Synthetic peptide
CVTWDTSLTSVVL

SEQ ID NO: 835 - protein, 14 aa, Artificial Sequence
  Description of Artificial Sequence: Synthetic peptide
CVTWDTSLSVYWVF

SEQ ID NO: 836 - protein, 13 aa, Artificial Sequence
  Description of Artificial Sequence: Synthetic peptide
CVTWDTSLSAWVF

SEQ ID NO: 837 - protein, 13 aa, Artificial Sequence
  Description of Artificial Sequence: Synthetic peptide
CVTWDTDLSVALF

SEQ ID NO: 838 - protein, 13 aa, Artificial Sequence
  Description of Artificial Sequence: Synthetic peptide
CVTWDRSLSGWVF

SEQ ID NO: 839 - protein, 13 aa, Artificial Sequence
  Description of Artificial Sequence: Synthetic peptide
CVTWDRSLREVLF

SEQ ID NO: 840 - protein, 13 aa, Artificial Sequence
  Description of Artificial Sequence: Synthetic peptide
CVTWDRSLRAVVF

SEQ ID NO: 841 - protein, 13 aa, Artificial Sequence
  Description of Artificial Sequence: Synthetic peptide
CVTWDRSLDAGVF

SEQ ID NO: 842 - protein, 13 aa, Artificial Sequence
  Description of Artificial Sequence: Synthetic peptide
CVTWDNTLSAGVF

SEQ ID NO: 843 - protein, 13 aa, Artificial Sequence
  Description of Artificial Sequence: Synthetic peptide
CVTWDNNLFGVVF

SEQ ID NO: 844 - protein, 13 aa, Artificial Sequence
  Description of Artificial Sequence: Synthetic peptide
CVSWDTSLSGAVF

SEQ ID NO: 845 - protein, 13 aa, Artificial Sequence
  Description of Artificial Sequence: Synthetic peptide
CVSWDTSLSAGVF

SEQ ID NO: 846 - protein, 13 aa, Artificial Sequence
  Description of Artificial Sequence: Synthetic peptide
CTTWFRTPSDVVF

SEQ ID NO: 847 - protein, 13 aa, Artificial Sequence
  Description of Artificial Sequence: Synthetic peptide
CTTWFRTASDVVF

SEQ ID NO: 848 - protein, 12 aa, Artificial Sequence
  Description of Artificial Sequence: Synthetic peptide
CTTWDYGLSVVF

SEQ ID NO: 849 - protein, 14 aa, Artificial Sequence
  Description of Artificial Sequence: Synthetic peptide
CTARDTSLSPGGVF

SEQ ID NO: 850 - protein, 13 aa, Artificial Sequence
  Description of Artificial Sequence: Synthetic peptide
CSTWNTRPSDVVF

SEQ ID NO: 851 - protein, 13 aa, Artificial Sequence
  Description of Artificial Sequence: Synthetic peptide
CSTWESSLTTVVF

SEQ ID NO: 852 - protein, 13 aa, Artificial Sequence
  Description of Artificial Sequence: Synthetic peptide
CSTWDTSLTNVLF

SEQ ID NO: 853 - protein, 13 aa, Artificial Sequence
  Description of Artificial Sequence: Synthetic peptide
CSTWDTSLSGVVF

SEQ ID NO: 854 - protein, 13 aa, Artificial Sequence
  Description of Artificial Sequence: Synthetic peptide
CSTWDHSLKAALF

SEQ ID NO: 855 - protein, 13 aa, Artificial Sequence
  Description of Artificial Sequence: Synthetic peptide
CSTWDARLSVRVF

SEQ ID NO: 856 - protein, 12 aa, Artificial Sequence [sequence omitted]

SEQ ID NO: 857 - protein, 13 aa, Artificial Sequence
  Description of Artificial Sequence: Synthetic peptide
CSSYATRGLRVLF

SEQ ID NO: 858 - protein, 13 aa, Artificial Sequence
  Description of Artificial Sequence: Synthetic peptide
CSSWDATLSVRIF

SEQ ID NO: 859 - protein, 13 aa, Artificial Sequence
  Description of Artificial Sequence: Synthetic peptide
CQVWEGSSDHWVF

SEQ ID NO: 860 - protein, 13 aa, Artificial Sequence
  Description of Artificial Sequence: Synthetic peptide
CQTWDNRLSAVVF

SEQ ID NO: 861 - protein, 13 aa, Artificial Sequence
  Description of Artificial Sequence: Synthetic peptide
CQTWDHSLHVGVF

SEQ ID NO: 862 - protein, 13 aa, Artificial Sequence
  Description of Artificial Sequence: Synthetic peptide
CQSYDDILNVWVL

SEQ ID NO: 863 - protein, 13 aa, Artificial Sequence
  Description of Artificial Sequence: Synthetic peptide
CNTWDKSLTSELF

SEQ ID NO: 864 - protein, 13 aa, Artificial Sequence
  Description of Artificial Sequence: Synthetic peptide
CLTWDRSLNVRVF

SEQ ID NO: 865 - protein, 13 aa, Artificial Sequence
  Description of Artificial Sequence: Synthetic peptide
CLTWDHSLTAYVF

SEQ ID NO: 866 - protein, 13 aa, Artificial Sequence
  Description of Artificial Sequence: Synthetic peptide
CLTRDTSLSAPVF

SEQ ID NO: 867 - protein, 14 aa, Artificial Sequence
  Description of Artificial Sequence: Synthetic peptide
CKTWESGLNFGHVF

SEQ ID NO: 868 - protein, 13 aa, Artificial Sequence
  Description of Artificial Sequence: Synthetic peptide
CKTWDTSLSAVVF

SEQ ID NO: 869 - protein, 13 aa, Artificial Sequence
  Description of Artificial Sequence: Synthetic peptide
CGVWDVSLGAGVF

SEQ ID NO: 870 - protein, 13 aa, Artificial Sequence
  Description of Artificial Sequence: Synthetic peptide
CGVWDTTPSAVLF

SEQ ID NO: 871 - protein, 13 aa, Artificial Sequence
  Description of Artificial Sequence: Synthetic peptide
CGVWDTTLSAVLF

SEQ ID NO: 872 - protein, 11 aa, Artificial Sequence
  Description of Artificial Sequence: Synthetic peptide
CGVWDTSLGVF

SEQ ID NO: 873 - protein, 13 aa, Artificial Sequence
  Description of Artificial Sequence: Synthetic peptide
CGVWDTNLGKWVF

SEQ ID NO: 874 - protein, 14 aa, Artificial Sequence
  Description of Artificial Sequence: Synthetic peptide
CGVWDTGLDAGWVF

SEQ ID NO: 875 - protein, 13 aa, Artificial Sequence
  Description of Artificial Sequence: Synthetic peptide
CGVWDNVLEAYVF

SEQ ID NO: 876 - protein, 14 aa, Artificial Sequence
  Description of Artificial Sequence: Synthetic peptide
CGVWDISLSANWVF

SEQ ID NO: 877 - protein, 13 aa, Artificial Sequence
  Description of Artificial Sequence: Synthetic peptide
CGVWDHSLGIWAF

SEQ ID NO: 878 - protein, 13 aa, Artificial Sequence
  Description of Artificial Sequence: Synthetic peptide
CGVWDDILTAEVF

SEQ ID NO: 879 - protein, 11 aa, Artificial Sequence
  Description of Artificial Sequence: Synthetic peptide
CGVRDTSLGVF

SEQ ID NO: 880 - protein, 13 aa, Artificial Sequence
  Description of Artificial Sequence: Synthetic peptide
CGTYDTSLPAWVF

SEQ ID NO: 881 - protein, 13 aa, Artificial Sequence
  Description of Artificial Sequence: Synthetic peptide
CGTYDNLVFGYVF

SEQ ID NO: 882 - protein, 12 aa, Artificial Sequence
  Description of Artificial Sequence: Synthetic peptide
CGTYDDRLREVF

SEQ ID NO: 883 - protein, 13 aa, Artificial Sequence
  Description of Artificial Sequence: Synthetic peptide
CGTWVTSLSAGVF

SEQ ID NO: 884 - protein, 13 aa, Artificial Sequence
  Description of Artificial Sequence: Synthetic peptide
CGTWVSSLTTVVF

SEQ ID NO: 885 - protein, 13 aa, Artificial Sequence
  Description of Artificial Sequence: Synthetic peptide
CGTWVSSLNVWVF

SEQ ID NO: 886 - protein, 11 aa, Artificial Sequence
  Description of Artificial Sequence: Synthetic peptide
CGTWVGRFWVF

SEQ ID NO: 887 - protein, 14 aa, Artificial Sequence
  Description of Artificial Sequence: Synthetic peptide
CGTWSGGPSGHWLF

SEQ ID NO: 888 - protein, 14 aa, Artificial Sequence
  Description of Artificial Sequence: Synthetic peptide
CGTWSGGLSGHWLF

SEQ ID NO: 889 - protein, 13 aa, Artificial Sequence
  Description of Artificial Sequence: Synthetic peptide
CGTWQTGREAVLF

SEQ ID NO: 890 - protein, 12 aa, Artificial Sequence
  Description of Artificial Sequence: Synthetic peptide
CGTWQSRLRWVF

SEQ ID NO: 891 - protein, 12 aa, Artificial Sequence
  Description of Artificial Sequence: Synthetic peptide
CGTWQSRLGWVF

SEQ ID NO: 892 - protein, 14 aa, Artificial Sequence
  Description of Artificial Sequence: Synthetic peptide
CGTWPRSLSAVWVF

SEQ ID NO: 893 - protein, 15 aa, Artificial Sequence
  Description of Artificial Sequence: Synthetic peptide
CGTWNNYLSAGDVVF

SEQ ID NO: 894 - protein, 14 aa, Artificial Sequence
  Description of Artificial Sequence: Synthetic peptide
CGTWLGSQSPYWVF

SEQ ID NO: 895 - protein, 13 aa, Artificial Sequence
  Description of Artificial Sequence: Synthetic peptide
CGTWHTGLSAYVF

SEQ ID NO: 896 - protein, 15 aa, Artificial Sequence
  Description of Artificial Sequence: Synthetic peptide
CGTWHSTLSAGHWVF

SEQ ID NO: 897 - protein, 13 aa, Artificial Sequence
  Description of Artificial Sequence: Synthetic peptide
CGTWHSSLSTWVF

SEQ ID NO: 898 - protein, 13 aa, Artificial Sequence [sequence omitted]

SEQ ID NO: 899 - protein, 13 aa, Artificial Sequence
  Description of Artificial Sequence: Synthetic peptide
CGTWHSSLSAVVF

SEQ ID NO: 900 - protein, 13 aa, Artificial Sequence
  Description of Artificial Sequence: Synthetic peptide
CGTWHSGLSGWVF

SEQ ID NO: 901 - protein, 13 aa, Artificial Sequence
  Description of Artificial Sequence: Synthetic peptide
CGTWHNTLRNVIF

SEQ ID NO: 902 - protein, 12 aa, Artificial Sequence
  Description of Artificial Sequence: Synthetic peptide
CGTWHASLTAVF

SEQ ID NO: 903 - protein, 15 aa, Artificial Sequence
  Description of Artificial Sequence: Synthetic peptide
CGTWGWYGSQRGVVF

SEQ ID NO: 904 - protein, 15 aa, Artificial Sequence
  Description of Artificial Sequence: Synthetic peptide
CGTWGWYGGQRGVVF

SEQ ID NO: 905 - protein, 13 aa, Artificial Sequence
  Description of Artificial Sequence: Synthetic peptide
CGTWGTSLSAWVF

SEQ ID NO: 906 - protein, 13 aa, Artificial Sequence
  Description of Artificial Sequence: Synthetic peptide
CGTWGSSLTTGLF

SEQ ID NO: 907 - protein, 13 aa, Artificial Sequence
  Description of Artificial Sequence: Synthetic peptide
CGTWGSSLTAYVF

SEQ ID NO: 908 - protein, 12 aa, Artificial Sequence
  Description of Artificial Sequence: Synthetic peptide
CGTWGSSLSVVF

SEQ ID NO: 909 - protein, 13 aa, Artificial Sequence
  Description of Artificial Sequence: Synthetic peptide
CGTWGSSLSGGVF

SEQ ID NO: 910 - protein, 14 aa, Artificial Sequence
  Description of Artificial Sequence: Synthetic peptide
CGTWGSSLSAYWVF

SEQ ID NO: 911 - protein, 14 aa, Artificial Sequence
  Description of Artificial Sequence: Synthetic peptide
CGTWGSSLSAYVVF

SEQ ID NO: 912 - protein, 13 aa, Artificial Sequence
  Description of Artificial Sequence: Synthetic peptide
CGTWGSSLSAYVF

SEQ ID NO: 913 - protein, 13 aa, Artificial Sequence [sequence omitted]

SEQ ID NO: 914 - protein, 14 aa, Artificial Sequence
  Description of Artificial Sequence: Synthetic peptide
CGTWGSSLSAPYVF

SEQ ID NO: 915 - protein, 13 aa, Artificial Sequence
  Description of Artificial Sequence: Synthetic peptide
CGTWGSSLSAPVF

SEQ ID NO: 916 - protein, 13 aa, Artificial Sequence
  Description of Artificial Sequence: Synthetic peptide
CGTWGSSLSAGVF

SEQ ID NO: 917 - protein, 13 aa, Artificial Sequence
  Description of Artificial Sequence: Synthetic peptide
CGTWGSSLSAGLF

SEQ ID NO: 918 - protein, 14 aa, Artificial Sequence
  Description of Artificial Sequence: Synthetic peptide
CGTWGSSLSAGALF

SEQ ID NO: 919 - protein, 13 aa, Artificial Sequence
  Description of Artificial Sequence: Synthetic peptide
CGTWGSSLRAWVF

SEQ ID NO: 920 - protein, 13 aa, Artificial Sequence
  Description of Artificial Sequence: Synthetic peptide
CGTWFTSLASGVF

SEQ ID NO: 921 - protein, 13 aa, Artificial Sequence
  Description of Artificial Sequence: Synthetic peptide
CGTWETSLSVVVI

SEQ ID NO: 922 - protein, 12 aa, Artificial Sequence
  Description of Artificial Sequence: Synthetic peptide
CGTWETSLSGVF

SEQ ID NO: 923 - protein, 13 aa, Artificial Sequence
  Description of Artificial Sequence: Synthetic peptide
CGTWETSLSDWVF

SEQ ID NO: 924 - protein, 13 aa, Artificial Sequence [sequence omitted]

SEQ ID NO: 925 - protein, 13 aa, Artificial Sequence
  Description of Artificial Sequence: Synthetic peptide
CGTWETSLNYVAF

SEQ ID NO: 926 - protein, 13 aa, Artificial Sequence
  Description of Artificial Sequence: Synthetic peptide
CGTWETSLNTWLL

SEQ ID NO: 927 - protein, 14 aa, Artificial Sequence
  Description of Artificial Sequence: Synthetic peptide
CGTWETSESGNYIF

SEQ ID NO: 928 - protein, 13 aa, Artificial Sequence
  Description of Artificial Sequence: Synthetic peptide
CGTWETRLGTWVI

SEQ ID NO: 929 - protein, 12 aa, Artificial Sequence
  Description of Artificial Sequence: Synthetic peptide
CGTWETQLYWVF

SEQ ID NO: 930 - protein, 14 aa, Artificial Sequence
  Description of Artificial Sequence: Synthetic peptide
CGTWETGLSAGEVF

SEQ ID NO: 931 - protein, 13 aa, Artificial Sequence
  Description of Artificial Sequence: Synthetic peptide
CGTWESTLSVFLF

SEQ ID NO: 932 - protein, 13 aa, Artificial Sequence [sequence omitted]

SEQ ID NO: 933 - protein, 13 aa, Artificial Sequence
  Description of Artificial Sequence: Synthetic peptide
CGTWESSLTGVVF

SEQ ID NO: 934 - protein, 13 aa, Artificial Sequence
  Description of Artificial Sequence: Synthetic peptide
CGTWESSLTGFVF

SEQ ID NO: 935 - protein, 13 aa, Artificial Sequence
  Description of Artificial Sequence: Synthetic peptide
CGTWESSLSVGVF

SEQ ID NO: 936 - protein, 13 aa, Artificial Sequence
  Description of Artificial Sequence: Synthetic peptide
CGTWESSLSEWVF

SEQ ID NO: 937 - protein, 12 aa, Artificial Sequence
  Description of Artificial Sequence: Synthetic peptide
CGTWESSLSAVF

SEQ ID NO: 938 - protein, 14 aa, Artificial Sequence
  Description of Artificial Sequence: Synthetic peptide
CGTWESSLSAGYIF

SEQ ID NO: 939 - protein, 13 aa, Artificial Sequence [sequence omitted]

SEQ ID NO: 940 - protein, 14 aa, Artificial Sequence
  Description of Artificial Sequence: Synthetic peptide
CGTWESSLSAGPVF

SEQ ID NO: 941 - protein, 15 aa, Artificial Sequence
  Description of Artificial Sequence: Synthetic peptide
CGTWESSLSAGGQVF

SEQ ID NO: 942 - protein, 16 aa, Artificial Sequence
  Description of Artificial Sequence: Synthetic peptide
CGTWESSLSAFGGYVF

SEQ ID NO: 943 - protein, 13 aa, Artificial Sequence
  Description of Artificial Sequence: Synthetic peptide
CGTWESSLRVWVF

SEQ ID NO: 944 - protein, 15 aa, Artificial Sequence
  Description of Artificial Sequence: Synthetic peptide
CGTWESSLFTGPWVF

SEQ ID NO: 945 - protein, 13 aa, Artificial Sequence
  Description of Artificial Sequence: Synthetic peptide
CGTWESLSATYVF

SEQ ID NO: 946 - protein, 13 aa, Artificial Sequence
  Description of Artificial Sequence: Synthetic peptide
CGTWESGLSAGVF

SEQ ID NO: 947 - protein, 11 aa, Artificial Sequence
  Description of Artificial Sequence: Synthetic peptide
CGTWESDFWVF

SEQ ID NO: 948 - protein, 13 aa, Artificial Sequence
  Description of Artificial Sequence: Synthetic peptide
CGTWENRLSAVVF

SEQ ID NO: 949 - protein, 13 aa, Artificial Sequence
  Description of Artificial Sequence: Synthetic peptide
CGTWENRLSAGVF

SEQ ID NO: 950 - protein, 14 aa, Artificial Sequence
  Description of Artificial Sequence: Synthetic peptide
CGTWEISLTTSVVF

SEQ ID NO: 951 - protein, 14 aa, Artificial Sequence
  Description of Artificial Sequence: Synthetic peptide
CGTWEISLSTSVVF

SEQ ID NO: 952 - protein, 12 aa, Artificial Sequence
  Description of Artificial Sequence: Synthetic peptide
CGTWEGSLSVVF

SEQ ID NO: 953 - protein, 11 aa, Artificial Sequence
  Description of Artificial Sequence: Synthetic peptide
CGTWEGSLRVF

SEQ ID NO: 954 - protein, 12 aa, Artificial Sequence
  Description of Artificial Sequence: Synthetic peptide
CGTWEGSLRHVF

SEQ ID NO: 955 - protein, 14 aa, Artificial Sequence
  Description of Artificial Sequence: Synthetic peptide
CGTWDYSPVRAGVF

SEQ ID NO: 956 - protein, 13 aa, Artificial Sequence
  Description of Artificial Sequence: Synthetic peptide
CGTWDYSLSVYLF

SEQ ID NO: 957 - protein, 14 aa, Artificial Sequence
  Description of Artificial Sequence: Synthetic peptide
CGTWDYSLSSGVVF

SEQ ID NO: 958 - protein, 13 aa, Artificial Sequence [sequence omitted]

SEQ ID NO: 959 - protein, 13 aa, Artificial Sequence
  Description of Artificial Sequence: Synthetic peptide
CGTWDYSLSAEVF

SEQ ID NO: 960 - protein, 13 aa, Artificial Sequence
  Description of Artificial Sequence: Synthetic peptide
CGTWDYSLRRAIF

SEQ ID NO: 961 - protein, 13 aa, Artificial Sequence
  Description of Artificial Sequence: Synthetic peptide
CGTWDWSLILQLF

SEQ ID NO: 962 - protein, 13 aa, Artificial Sequence
  Description of Artificial Sequence: Synthetic peptide
CGTWDVTLHTGVF

SEQ ID NO: 963 - protein, 13 aa, Artificial Sequence
  Description of Artificial Sequence: Synthetic peptide
CGTWDVTLHIGVF

SEQ ID NO: 964 - protein, 13 aa, Artificial Sequence
  Description of Artificial Sequence: Synthetic peptide
CGTWDVTLHAGVF

SEQ ID NO: 965 - protein, 14 aa, Artificial Sequence
  Description of Artificial Sequence: Synthetic peptide
CGTWDVSLYSGGVF

SEQ ID NO: 966 - protein, 13 aa, Artificial Sequence
  Description of Artificial Sequence: Synthetic peptide
CGTWDVSLTSFVF

SEQ ID NO: 967 - protein, 13 aa, Artificial Sequence
  Description of Artificial Sequence: Synthetic peptide
CGTWDVSLSVGVL

SEQ ID NO: 968 - protein, 15 aa, Artificial Sequence
  Description of Artificial Sequence: Synthetic peptide
CGTWDVSLSAGDVVF

SEQ ID NO: 969 - protein, 13 aa, Artificial Sequence
  Description of Artificial Sequence: Synthetic peptide
CGTWDVSLNVVVF

SEQ ID NO: 970 - protein, 13 aa, Artificial Sequence
  Description of Artificial Sequence: Synthetic peptide
CGTWDVSLNTQVF

SEQ ID NO: 971 - protein, 12 aa, Artificial Sequence
  Description of Artificial Sequence: Synthetic peptide
CGTWDVSLGALF

SEQ ID NO: 972 - protein, 13 aa, Artificial Sequence
  Description of Artificial Sequence: Synthetic peptide
CGTWDVNLKTVVF

SEQ ID NO: 973 - protein, 13 aa, Artificial Sequence
  Description of Artificial Sequence: Synthetic peptide
CGTWDVILSAEVF

SEQ ID NO: 974 - protein, 13 aa, Artificial Sequence
  Description of Artificial Sequence: Synthetic peptide
CGTWDTTVSAVVF

SEQ ID NO: 975 - protein, 13 aa, Artificial Sequence
  Description of Artificial Sequence: Synthetic peptide
CGTWDTTLTAWVF

SEQ ID NO: 976 - protein, 13 aa, Artificial Sequence
  Description of Artificial Sequence: Synthetic peptide
CGTWDTTLSVFLF

SEQ ID NO: 977 - protein, 13 aa, Artificial Sequence
  Description of Artificial Sequence: Synthetic peptide
CGTWDTSVSAGVF

SEQ ID NO: 978 - protein, 13 aa, Artificial Sequence
  Description of Artificial Sequence: Synthetic peptide
CGTWDTSVISWVF

SEQ ID NO: 979 - protein, 15 aa, Artificial Sequence
  Description of Artificial Sequence: Synthetic peptide
CGTWDTSRSSLYVVF

SEQ ID NO: 980 - protein, 13 aa, Artificial Sequence
  Description of Artificial Sequence: Synthetic peptide
CGTWDTSRSAWVF

SEQ ID NO: 981 - protein, 14 aa, Artificial Sequence
  Description of Artificial Sequence: Synthetic peptide
CGTWDTSRNPGGIF

SEQ ID NO: 982 - protein, 12 aa, Artificial Sequence
  Description of Artificial Sequence: Synthetic peptide
CGTWDTSRGHVF

SEQ ID NO: 983 - protein, 15 aa, Artificial Sequence
  Description of Artificial Sequence: Synthetic peptide
CGTWDTSPSTGQVLF

SEQ ID NO: 984 - protein, 13 aa, Artificial Sequence
  Description of Artificial Sequence: Synthetic peptide
CGTWDTSPSAWVF

SEQ ID NO: 985 - protein, 12 aa, Artificial Sequence
  Description of Artificial Sequence: Synthetic peptide
CGTWDTSLTWVF

SEQ ID NO: 986 - protein, 14 aa, Artificial Sequence
  Description of Artificial Sequence: Synthetic peptide
CGTWDTSLTWFAVF

SEQ ID NO: 987 - protein, 13 aa, Artificial Sequence
  Description of Artificial Sequence: Synthetic peptide
CGTWDTSLTVVVF

SEQ ID NO: 988 - protein, 14 aa, Artificial Sequence
  Description of Artificial Sequence: Synthetic peptide
CGTWDTSLTTSWVF

SEQ ID NO: 989 - protein, 16 aa, Artificial Sequence
  Description of Artificial Sequence: Synthetic peptide
CGTWDTSLTTGPFWVF

SEQ ID NO: 990 - protein, 14 aa, Artificial Sequence
  Description of Artificial Sequence: Synthetic peptide
CGTWDTSLTPFYVF

SEQ ID NO: 991 - protein, 13 aa, Artificial Sequence [sequence omitted]

SEQ ID NO: 992 - protein, 13 aa, Artificial Sequence
  Description of Artificial Sequence: Synthetic peptide
CGTWDTSLTAWVF

SEQ ID NO: 993 - protein, 14 aa, Artificial Sequence
  Description of Artificial Sequence: Synthetic peptide
CGTWDTSLTAWGVF

SEQ ID NO: 994 - protein, 13 aa, Artificial Sequence
  Description of Artificial Sequence: Synthetic peptide
CGTWDTSLTAVVL

SEQ ID NO: 995 - protein, 13 aa, Artificial Sequence
  Description of Artificial Sequence: Synthetic peptide
CGTWDTSLTARVF

SEQ ID NO: 996 - protein, 13 aa, Artificial Sequence
  Description of Artificial Sequence: Synthetic peptide
CGTWDTSLTAIVF

SEQ ID NO: 997 - protein, 13 aa, Artificial Sequence [sequence omitted]

SEQ ID NO: 998 - protein, 13 aa, Artificial Sequence [sequence omitted]

SEQ ID NO: 999 - protein, 12 aa, Artificial Sequence [sequence omitted]

SEQ ID NO: 1000 - protein, 13 aa, Artificial Sequence
  Description of Artificial Sequence: Synthetic peptide
CGTWDTSLSVGEF

SEQ ID NO: 1001 - protein, 13 aa, Artificial Sequence
  Description of Artificial Sequence: Synthetic peptide
CGTWDTSLSTWVF

SEQ ID NO: 1002 - protein, 13 aa, Artificial Sequence [sequence omitted]

SEQ ID NO: 1003 - protein, 15 aa, Artificial Sequence
  Description of Artificial Sequence: Synthetic peptide
CGTWDTSLSTGQVLF

SEQ ID NO: 1004 - protein, 16 aa, Artificial Sequence
  Description of Artificial Sequence: Synthetic peptide
CGTWDTSLSTGPLWVF

SEQ ID NO: 1005 - protein, 13 aa, Artificial Sequence
  Description of Artificial Sequence: Synthetic peptide
CGTWDTSLSSYVF

SEQ ID NO: 1006 - protein, 13 aa, Artificial Sequence [sequence omitted]

SEQ ID NO: 1007 - protein, 14 aa, Artificial Sequence
  Description of Artificial Sequence: Synthetic peptide
CGTWDTSLSSRYIF

SEQ ID NO: 1008 - protein, 14 aa, Artificial Sequence
  Description of Artificial Sequence: Synthetic peptide
CGTWDTSLSSRFIF

SEQ ID NO: 1009 - protein, 14 aa, Artificial Sequence
  Description of Artificial Sequence: Synthetic peptide
CGTWDTSLSSGWVF

SEQ ID NO: 1010 - protein, 13 aa, Artificial Sequence
  Description of Artificial Sequence: Synthetic peptide
CGTWDTSLSRYVF

SEQ ID NO: 1011 - protein, 13 aa, Artificial Sequence
  Description of Artificial Sequence: Synthetic peptide
CGTWDTSLSQWLF

SEQ ID NO: 1012 - protein, 15 aa, Artificial Sequence
  Description of Artificial Sequence: Synthetic peptide
CGTWDTSLSPGLWVF

SEQ ID NO: 1013 - protein, 13 aa, Artificial Sequence
  Description of Artificial Sequence: Synthetic peptide
CGTWDTSLSNYVF

SEQ ID NO: 1014 - protein, 13 aa, Artificial Sequence [sequence omitted]

SEQ ID NO: 1015 - protein, 16 aa, Artificial Sequence
  Description of Artificial Sequence: Synthetic peptide
CGTWDTSLSIGPFWVF

SEQ ID NO: 1016 - protein, 13 aa, Artificial Sequence [sequence omitted]

SEQ ID NO: 1017 - protein, 13 aa, Artificial Sequence
  Description of Artificial Sequence: Synthetic peptide
CGTWDTSLSGTVF

SEQ ID NO: 1018 - protein, 14 aa, Artificial Sequence
  Description of Artificial Sequence: Synthetic peptide
CGTWDTSLSGGQVF

SEQ ID NO: 1019 - protein, 13 aa, Artificial Sequence
  Description of Artificial Sequence: Synthetic peptide
CGTWDTSLSGGIF

SEQ ID NO: 1020 - protein, 15 aa, Artificial Sequence
  Description of Artificial Sequence: Synthetic peptide
CGTWDTSLSGEDVVI

SEQ ID NO: 1021 - protein, 14 aa, Artificial Sequence
  Description of Artificial Sequence: Synthetic peptide
CGTWDTSLSFLYAF

SEQ ID NO: 1022 - protein, 13 aa, Artificial Sequence
  Description of Artificial Sequence: Synthetic peptide
CGTWDTSLSEVVF

SEQ ID NO: 1023 - protein, 12 aa, Artificial Sequence
  Description of Artificial Sequence: Synthetic peptide
CGTWDTSLSEVF

SEQ ID NO: 1024 - protein, 14 aa, Artificial Sequence
  Description of Artificial Sequence: Synthetic peptide
CGTWDTSLSENWVF

SEQ ID NO: 1025 - protein, 13 aa, Artificial Sequence
  Description of Artificial Sequence: Synthetic peptide
CGTWDTSLSAYIF

SEQ ID NO: 1026 - protein, 13 aa, Artificial Sequence
  Description of Artificial Sequence: Synthetic peptide
CGTWDTSLSAVVL

SEQ ID NO: 1027 - protein, 12 aa, Artificial Sequence [sequence omitted]

SEQ ID NO: 1028 - protein, 13 aa, Artificial Sequence [sequence omitted]

SEQ ID NO: 1029 - protein, 14 aa, Artificial Sequence
  Description of Artificial Sequence: Synthetic peptide
CGTWDTSLSARQVF

SEQ ID NO: 1030 - protein, 13 aa, Artificial Sequence
  Description of Artificial Sequence: Synthetic peptide
CGTWDTSLSALVF

SEQ ID NO: 1031 - protein, 13 aa, Artificial Sequence
  Description of Artificial Sequence: Synthetic peptide
CGTWDTSLSAKVF

SEQ ID NO: 1032 - protein, 13 aa, Artificial Sequence
  Description of Artificial Sequence: Synthetic peptide
CGTWDTSLSAKIF

SEQ ID NO: 1033 - protein, 14 aa, Artificial Sequence
  Description of Artificial Sequence: Synthetic peptide
CGTWDTSLSAKAVF

SEQ ID NO: 1034 - protein, 14 aa, Artificial Sequence
  Description of Artificial Sequence: Synthetic peptide
CGTWDTSLSAHAVF

SEQ ID NO: 1035 - protein, 14 aa, Artificial Sequence
  Description of Artificial Sequence: Synthetic peptide
CGTWDTSLSAGYVF

SEQ ID NO: 1036 - protein, 15 aa, Artificial Sequence
  Description of Artificial Sequence: Synthetic peptide
CGTWDTSLSAGRWVF

SEQ ID NO: 1037 - protein, 13 aa, Artificial Sequence
  Description of Artificial Sequence: Synthetic peptide
CGTWDTSLSAGIF

SEQ ID NO: 1038 - protein, 16 aa, Artificial Sequence
  Description of Artificial Sequence: Synthetic peptide
CGTWDTSLSAGGFRVF

SEQ ID NO: 1039 - protein, 13 aa, Artificial Sequence
  Description of Artificial Sequence: Synthetic peptide
CGTWDTSLSAGAF

SEQ ID NO: 1040 - protein, 14 aa, Artificial Sequence
  Description of Artificial Sequence: Synthetic peptide
CGTWDTSLSADWFF

SEQ ID NO: 1041 - protein, 15 aa, Artificial Sequence
  Description of Artificial Sequence: Synthetic peptide
CGTWDTSLSADEYVF

SEQ ID NO: 1042 - protein, 14 aa, Artificial Sequence
  Description of Artificial Sequence: Synthetic peptide
CGTWDTSLSAAWVF

SEQ ID NO: 1043 - protein, 13 aa, Artificial Sequence
  Description of Artificial Sequence: Synthetic peptide
CGTWDTSLSAALF

SEQ ID NO: 1044 - protein, 14 aa, Artificial Sequence
  Description of Artificial Sequence: Synthetic peptide
CGTWDTSLSAAGVF

SEQ ID NO: 1045 - protein, 13 aa, Artificial Sequence
  Description of Artificial Sequence: Synthetic peptide
CGTWDTSLRVVVF

SEQ ID NO: 1046 - protein, 13 aa, Artificial Sequence
  Description of Artificial Sequence: Synthetic peptide
CGTWDTSLRTWVF

SEQ ID NO: 1047 - protein, 13 aa, Artificial Sequence
  Description of Artificial Sequence: Synthetic peptide
CGTWDTSLRGAVF

SEQ ID NO: 1048 - protein, 13 aa, Artificial Sequence [sequence omitted]

SEQ ID NO: 1049 - protein, 14 aa, Artificial Sequence
  Description of Artificial Sequence: Synthetic peptide
CGTWDTSLNVVYVF

SEQ ID NO: 1050 - protein, 13 aa, Artificial Sequence
  Description of Artificial Sequence: Synthetic peptide
CGTWDTSLNTYLF

SEQ ID NO: 1051 - protein, 14 aa, Artificial Sequence
  Description of Artificial Sequence: Synthetic peptide
CGTWDTSLNFAWLF

SEQ ID NO: 1052 - protein, 13 aa, Artificial Sequence
  Description of Artificial Sequence: Synthetic peptide
CGTWDTSLLVWLF

SEQ ID NO: 1053 - protein, 13 aa, Artificial Sequence
  Description of Artificial Sequence: Synthetic peptide
CGTWDTSLKTWVF

SEQ ID NO: 1054 - protein, 13 aa, Artificial Sequence
  Description of Artificial Sequence: Synthetic peptide
CGTWDTSLIVWVF

SEQ ID NO: 1055 - protein, 13 aa, Artificial Sequence
  Description of Artificial Sequence: Synthetic peptide
CGTWDTSLITGVF

SEQ ID NO: 1056 - protein, 13 aa, Artificial Sequence
  Description of Artificial Sequence: Synthetic peptide
CGTWDTSLISVVF

SEQ ID NO: 1057 - protein, 13 aa, Artificial Sequence [sequence omitted]

SEQ ID NO: 1058 - protein, 13 aa, Artificial Sequence
  Description of Artificial Sequence: Synthetic peptide
CGTWDTSLHTELF

SEQ ID NO: 1059 - protein, 13 aa, Artificial Sequence
  Description of Artificial Sequence: Synthetic peptide
CGTWDTSLGSYVF

SEQ ID NO: 1060 - protein, 14 aa, Artificial Sequence
  Description of Artificial Sequence: Synthetic peptide
CGTWDTSLGSLWVF

SEQ ID NO: 1061 - protein, 13 aa, Artificial Sequence
  Description of Artificial Sequence: Synthetic peptide
CGTWDTSLGSGVF

SEQ ID NO: 1062 - protein, 14 aa, Artificial Sequence
  Description of Artificial Sequence: Synthetic peptide
CGTWDTSLGGRGVF

SEQ ID NO: 1063 - protein, 13 aa, Artificial Sequence
  Description of Artificial Sequence: Synthetic peptide
CGTWDTSLGAWVF

SEQ ID NO: 1064 - protein, 13 aa, Artificial Sequence
  Description of Artificial Sequence: Synthetic peptide
CGTWDTSLGAVVF

SEQ ID NO: 1065 - protein, 13 aa, Artificial Sequence [sequence omitted]

SEQ ID NO: 1066 - protein, 13 aa, Artificial Sequence
  Description of Artificial Sequence: Synthetic peptide
CGTWDTSLGAGLF

SEQ ID NO: 1067 - protein, 13 aa, Artificial Sequence
  Description of Artificial Sequence: Synthetic peptide
CGTWDTSLDAVVF

SEQ ID NO: 1068 - protein, 13 aa, Artificial Sequence
  Description of Artificial Sequence: Synthetic peptide
CGTWDTSLDAVLF

SEQ ID NO: 1069 - protein, 12 aa, Artificial Sequence
  Description of Artificial Sequence: Synthetic peptide
CGTWDTSLAWVF

SEQ ID NO: 1070 - protein, 13 aa, Artificial Sequence
  Description of Artificial Sequence: Synthetic peptide
CGTWDTSLATGLF

SEQ ID NO: 1071 - protein, 13 aa, Artificial Sequence
  Description of Artificial Sequence: Synthetic peptide
CGTWDTSLAPVVF

SEQ ID NO: 1072 - protein, 13 aa, Artificial Sequence
  Description of Artificial Sequence: Synthetic peptide
CGTWDTRLTIVIF

SEQ ID NO: 1073 - protein, 13 aa, Artificial Sequence
  Description of Artificial Sequence: Synthetic peptide
CGTWDTRLSVWLF

SEQ ID NO: 1074 - protein, 13 aa, Artificial Sequence
  Description of Artificial Sequence: Synthetic peptide
CGTWDTRLSVGVF

SEQ ID NO: 1075 - protein, 13 aa, Artificial Sequence
  Description of Artificial Sequence: Synthetic peptide
CGTWDTRLSTVIF

SEQ ID NO: 1076 - protein, 13 aa, Artificial Sequence
  Description of Artificial Sequence: Synthetic peptide
CGTWDTRLSSVVF

SEQ ID NO: 1077 - protein, 13 aa, Artificial Sequence
  Description of Artificial Sequence: Synthetic peptide
CGTWDTRLSIVVF

SEQ ID NO: 1078 - protein, 14 aa, Artificial Sequence
  Description of Artificial Sequence: Synthetic peptide
CGTWDTRLSAYVVF

SEQ ID NO: 1079 - protein, 13 aa, Artificial Sequence [sequence omitted]

SEQ ID NO: 1080 - protein, 13 aa, Artificial Sequence [sequence omitted]

SEQ ID NO: 1081 - protein, 13 aa, Artificial Sequence
  Description of Artificial Sequence: Synthetic peptide
CGTWDTRLSAGLF

SEQ ID NO: 1082 - protein, 14 aa, Artificial Sequence
  Description of Artificial Sequence: Synthetic peptide
CGTWDTRLSAGGVF

SEQ ID NO: 1083 - protein, 13 aa, Artificial Sequence
  Description of Artificial Sequence: Synthetic peptide
CGTWDTRLNVWLF

SEQ ID NO: 1084 - protein, 13 aa, Artificial Sequence
  Description of Artificial Sequence: Synthetic peptide
CGTWDTNREVVLL

SEQ ID NO: 1085 - protein, 13 aa, Artificial Sequence
  Description of Artificial Sequence: Synthetic peptide
CGTWDTNLRAHVF

SEQ ID NO: 1086 - protein, 13 aa, Artificial Sequence
  Description of Artificial Sequence: Synthetic peptide
CGTWDTNLPAVVF

SEQ ID NO: 1087 - protein, 12 aa, Artificial Sequence
  Description of Artificial Sequence: Synthetic peptide
CGTWDTNLGGVF

SEQ ID NO: 1088 - protein, 13 aa, Artificial Sequence
  Description of Artificial Sequence: Synthetic peptide
CGTWDTIVSIGVF

SEQ ID NO: 1089 - protein, 13 aa, Artificial Sequence
  Description of Artificial Sequence: Synthetic peptide
CGTWDTILSAVVF

SEQ ID NO: 1090 - protein, 13 aa, Artificial Sequence
  Description of Artificial Sequence: Synthetic peptide
CGTWDTILSAEVF

SEQ ID NO: 1091 - protein, 12 aa, Artificial Sequence
  Description of Artificial Sequence: Synthetic peptide
CGTWDTHLGVVF

SEQ ID NO: 1092 - protein, 14 aa, Artificial Sequence
  Description of Artificial Sequence: Synthetic peptide
CGTWDTGPSPHWLF

SEQ ID NO: 1093 - protein, 14 aa, Artificial Sequence
  Description of Artificial Sequence: Synthetic peptide
CGTWDTGLTFGGVF

SEQ ID NO: 1094 - protein, 13 aa, Artificial Sequence
  Description of Artificial Sequence: Synthetic peptide
CGTWDTGLTAFVF

SEQ ID NO: 1095 - protein, 13 aa, Artificial Sequence
  Description of Artificial Sequence: Synthetic peptide
CGTWDTGLSVWVF

SEQ ID NO: 1096 - protein, 13 aa, Artificial Sequence
  Description of Artificial Sequence: Synthetic peptide
CGTWDTGLSTGIF

SEQ ID NO: 1097 - protein, 13 aa, Artificial Sequence
  Description of Artificial Sequence: Synthetic peptide
CGTWDTGLSSLLF

SEQ ID NO: 1098 - protein, 13 aa, Artificial Sequence
  Description of Artificial Sequence: Synthetic peptide
CGTWDTGLSIVVF

SEQ ID NO: 1099 - protein, 13 aa, Artificial Sequence
  Description of Artificial Sequence: Synthetic peptide
CGTWDTGLSFVVF

SEQ ID NO: 1100 - protein, 13 aa, Artificial Sequence
  Description of Artificial Sequence: Synthetic peptide
CGTWDTGLSAWVF

SEQ ID NO: 1101 - protein, 14 aa, Artificial Sequence
  Description of Artificial Sequence: Synthetic peptide
CGTWDTGLSAGVVF

SEQ ID NO: 1102 - protein, 13 aa, Artificial Sequence
  Description of Artificial Sequence: Synthetic peptide
CGTWDTGLRGWIF

SEQ ID NO: 1103 - protein, 13 aa, Artificial Sequence
  Description of Artificial Sequence: Synthetic peptide
CGTWDTELSAGVF

SEQ ID NO: 1104 - protein, 13 aa, Artificial Sequence
  Description of Artificial Sequence: Synthetic peptide
CGTWDTALTAGVF

SEQ ID NO: 1105 - protein, 13 aa, Artificial Sequence
  Description of Artificial Sequence: Synthetic peptide
CGTWDTALSLVVF

SEQ ID NO: 1106 - protein, 13 aa, Artificial Sequence
  Description of Artificial Sequence: Synthetic peptide
CGTWDTALSAWLF

SEQ ID NO: 1107 - protein, 13 aa, Artificial Sequence [sequence omitted]

SEQ ID NO: 1108 - protein, 13 aa, Artificial Sequence
  Description of Artificial Sequence: Synthetic peptide
CGTWDTALRGVLF

SEQ ID NO: 1109 - protein, 13 aa, Artificial Sequence
  Description of Artificial Sequence: Synthetic peptide
CGTWDTALKEWLF

SEQ ID NO: 1110 - protein, 15 aa, Artificial Sequence
  Description of Artificial Sequence: Synthetic peptide
CGTWDRTLTAGDVLF

SEQ ID NO: 1111 - protein, 12 aa, Artificial Sequence
  Description of Artificial Sequence: Synthetic peptide
CGTWDRSVTYVF

SEQ ID NO: 1112 - protein, 13 aa, Artificial Sequence
  Description of Artificial Sequence: Synthetic peptide
CGTWDRSRNEWVF

SEQ ID NO: 1113 - protein, 13 aa, Artificial Sequence [sequence omitted]

SEQ ID NO: 1114 - protein, 14 aa, Artificial Sequence
  Description of Artificial Sequence: Synthetic peptide
CGTWDRSLTPGWLF

SEQ ID NO: 1115 - protein, 13 aa, Artificial Sequence
  Description of Artificial Sequence: Synthetic peptide
CGTWDRSLTAWVF

SEQ ID NO: 1116 - protein, 13 aa, Artificial Sequence [sequence omitted]

SEQ ID NO: 1117 - protein, 12 aa, Artificial Sequence
  Description of Artificial Sequence: Synthetic peptide
CGTWDRSLSVVF

SEQ ID NO: 1118 - protein, 13 aa, Artificial Sequence
  Description of Artificial Sequence: Synthetic peptide
CGTWDRSLSVQLF

SEQ ID NO: 1119 - protein, 14 aa, Artificial Sequence
  Description of Artificial Sequence: Synthetic peptide
CGTWDRSLSVLWVF

SEQ ID NO: 1120 - protein, 13 aa, Artificial Sequence
  Description of Artificial Sequence: Synthetic peptide
CGTWDRSLSVGLF

SEQ ID NO: 1121 - protein, 13 aa, Artificial Sequence
  Description of Artificial Sequence: Synthetic peptide
CGTWDRSLSTWVF

SEQ ID NO: 1122 - protein, 14 aa, Artificial Sequence
  Description of Artificial Sequence: Synthetic peptide
CGTWDRSLSTHWVL

SEQ ID NO: 1123 - protein, 14 aa, Artificial Sequence
  Description of Artificial Sequence: Synthetic peptide
CGTWDRSLSTHWVF

SEQ ID NO: 1124 - protein, 13 aa, Artificial Sequence
  Description of Artificial Sequence: Synthetic peptide
CGTWDRSLSSAVF

SEQ ID NO: 1125 - protein, 14 aa, Artificial Sequence
  Description of Artificial Sequence: Synthetic peptide
CGTWDRSLSPSYVF

SEQ ID NO: 1126 - protein, 13 aa, Artificial Sequence
  Description of Artificial Sequence: Synthetic peptide
CGTWDRSLSGEVF

SEQ ID NO: 1127 - protein, 13 aa, Artificial Sequence
  Description of Artificial Sequence: Synthetic peptide
CGTWDRSLSGAVF

SEQ ID NO: 1128 - protein, 13 aa, Artificial Sequence
  Description of Artificial Sequence: Synthetic peptide
CGTWDRSLSAVAF

SEQ ID NO: 1129 - protein, 14 aa, Artificial Sequence
  Description of Artificial Sequence: Synthetic peptide
CGTWDRSLSAGGEF

SEQ ID NO: 1130 - protein, 14 aa, Artificial Sequence
  Description of Artificial Sequence: Synthetic peptide
CGTWDRSLSAFWVF

SEQ ID NO: 1131 - protein, 13 aa, Artificial Sequence
  Description of Artificial Sequence: Synthetic peptide
CGTWDRSLSAAVF

SEQ ID NO: 1132 - protein, 13 aa, Artificial Sequence
  Description of Artificial Sequence: Synthetic peptide
CGTWDRSLSAALF

SEQ ID NO: 1133 - protein, 11 aa, Artificial Sequence
  Description of Artificial Sequence: Synthetic peptide
CGTWDRSLRVF

SEQ ID NO: 1134 - protein, 12 aa, Artificial Sequence
  Description of Artificial Sequence: Synthetic peptide
CGTWDRSLNWVF

SEQ ID NO: 1135 - protein, 13 aa, Artificial Sequence
  Description of Artificial Sequence: Synthetic peptide
CGTWDRSLNVYVF

SEQ ID NO: 1136 - protein, 13 aa, Artificial Sequence
  Description of Artificial Sequence: Synthetic peptide
CGTWDRSLNVGVF

SEQ ID NO: 1137 - protein, 12 aa, Artificial Sequence
  Description of Artificial Sequence: Synthetic peptide
CGTWDRSLHVVF

SEQ ID NO: 1138 - protein, 13 aa, Artificial Sequence
  Description of Artificial Sequence: Synthetic peptide
CGTWDRSLGGWVF

SEQ ID NO: 1139 - protein, 14 aa, Artificial Sequence
  Description of Artificial Sequence: Synthetic peptide
CGTWDRSLGAFWVF

SEQ ID NO: 1140 - protein, 12 aa, Artificial Sequence
  Description of Artificial Sequence: Synthetic peptide
CGTWDRSLFWVF

SEQ ID NO: 1141 - protein, 13 aa, Artificial Sequence [sequence omitted]

SEQ ID NO: 1142 - protein, 13 aa, Artificial Sequence
  Description of Artificial Sequence: Synthetic peptide
CGTWDRRLSGVVF

SEQ ID NO: 1143 - protein, 13 aa, Artificial Sequence
  Description of Artificial Sequence: Synthetic peptide
CGTWDRRLSDVVF

SEQ ID NO: 1144 - protein, 13 aa, Artificial Sequence [sequence omitted]

SEQ ID NO: 1145 - protein, 13 aa, Artificial Sequence
  Description of Artificial Sequence: Synthetic peptide
CGTWDRRLNVAFF

SEQ ID NO: 1146 - protein, 12 aa, Artificial Sequence
  Description of Artificial Sequence: Synthetic peptide
CGTWDRRLLAVF

SEQ ID NO: 1147 - protein, 13 aa, Artificial Sequence
  Description of Artificial Sequence: Synthetic peptide
CGTWDRNLRAVVF

SEQ ID NO: 1148 - protein, 12 aa, Artificial Sequence
  Description of Artificial Sequence: Synthetic peptide
CGTWDRLSAGVF

SEQ ID NO: 1149 - protein, 13 aa, Artificial Sequence
  Description of Artificial Sequence: Synthetic peptide
CGTWDRGPNTGVF

SEQ ID NO: 1150 - protein, 14 aa, Artificial Sequence
  Description of Artificial Sequence: Synthetic peptide
CGTWDRGLNTVYVF

SEQ ID NO: 1151 - protein, 14 aa, Artificial Sequence
  Description of Artificial Sequence: Synthetic peptide
CGTWDNYVSAPWVF

SEQ ID NO: 1152 - protein, 15 aa, Artificial Sequence
  Description of Artificial Sequence: Synthetic peptide
CGTWDNYLSAGDVVF

SEQ ID NO: 1153 - protein, 13 aa, Artificial Sequence
  Description of Artificial Sequence: Synthetic peptide
CGTWDNYLRAGVF

SEQ ID NO: 1154 - protein, 13 aa, Artificial Sequence
  Description of Artificial Sequence: Synthetic peptide
CGTWDNYLGAVVF

SEQ ID NO: 1155 - protein, 13 aa, Artificial Sequence
  Description of Artificial Sequence: Synthetic peptide
CGTWDNYLGAGVF

SEQ ID NO: 1156 - protein, 14 aa, Artificial Sequence
  Description of Artificial Sequence: Synthetic peptide
CGTWDNTVSAPWVF

SEQ ID NO: 1157 - protein, 13 aa, Artificial Sequence
  Description of Artificial Sequence: Synthetic peptide
CGTWDNTLSLWVF

SEQ ID NO: 1158 - protein, 13 aa, Artificial Sequence [sequence omitted]

SEQ ID NO: 1159 - protein, 13 aa, Artificial Sequence
  Description of Artificial Sequence: Synthetic peptide
CGTWDNTLLTVLF

SEQ ID NO: 1160 - protein, 13 aa, Artificial Sequence
  Description of Artificial Sequence: Synthetic peptide
CGTWDNRLSSVIF

SEQ ID NO: 1161 - protein, 13 aa, Artificial Sequence [sequence omitted]

SEQ ID NO: 1162 - protein, 14 aa, Artificial Sequence
  Description of Artificial Sequence: Synthetic peptide
CGTWDNRLSAGGIF

SEQ ID NO: 1163 - protein, 13 aa, Artificial Sequence
  Description of Artificial Sequence: Synthetic peptide
CGTWDNRLSAEVF

SEQ ID NO: 1164 - protein, 13 aa, Artificial Sequence
  Description of Artificial Sequence: Synthetic peptide
CGTWDNRLRVGVL

SEQ ID NO: 1165 - protein, 13 aa, Artificial Sequence
  Description of Artificial Sequence: Synthetic peptide
CGTWDNRLLENVF

SEQ ID NO: 1166 - protein, 12 aa, Artificial Sequence
  Description of Artificial Sequence: Synthetic peptide
CGTWDNNLRAVF

SEQ ID NO: 1167 - protein, 13 aa, Artificial Sequence
  Description of Artificial Sequence: Synthetic peptide
CGTWDNNLRAGVF

SEQ ID NO: 1168 - protein, 14 aa, Artificial Sequence
  Description of Artificial Sequence: Synthetic peptide
CGTWDNNLGGGRVF

SEQ ID NO: 1169 - protein, 13 aa, Artificial Sequence
  Description of Artificial Sequence: Synthetic peptide
CGTWDNNLGAGVL

SEQ ID NO: 1170 - protein, 13 aa, Artificial Sequence
  Description of Artificial Sequence: Synthetic peptide
CGTWDNNLGAGVF

SEQ ID NO: 1171 - protein, 13 aa, Artificial Sequence
  Description of Artificial Sequence: Synthetic peptide
CGTWDNILSAAVF

SEQ ID NO: 1172 - protein, 13 aa, Artificial Sequence
  Description of Artificial Sequence: Synthetic peptide
CGTWDNILDAGVF

SEQ ID NO: 1173 - protein, 13 aa, Artificial Sequence
  Description of Artificial Sequence: Synthetic peptide
CGTWDNDLSGWLF

SEQ ID NO: 1174 - protein, 13 aa, Artificial Sequence
  Description of Artificial Sequence: Synthetic peptide
CGTWDNDLSAWVF

SEQ ID NO: 1175 - protein, 13 aa, Artificial Sequence
  Description of Artificial Sequence: Synthetic peptide
CGTWDLTLGGVVF

SEQ ID NO: 1176 - protein, 13 aa, Artificial Sequence
  Description of Artificial Sequence: Synthetic peptide
CGTWDLSLSAGVF

SEQ ID NO: 1177 - protein, 13 aa, Artificial Sequence
  Description of Artificial Sequence: Synthetic peptide
CGTWDLSLKEWVF

SEQ ID NO: 1178 - protein, 13 aa, Artificial Sequence
  Description of Artificial Sequence: Synthetic peptide
CGTWDLSLDAVVF

SEQ ID NO: 1179 - protein, 9 aa, Artificial Sequence
  Description of Artificial Sequence: Synthetic peptide
CGTWDLKVF

SEQ ID NO: 1180 - protein, 13 aa, Artificial Sequence
  Description of Artificial Sequence: Synthetic peptide
CGTWDKTLSVWVF

SEQ ID NO: 1181 - protein, 13 aa, Artificial Sequence
  Description of Artificial Sequence: Synthetic peptide
CGTWDKSLSVWVF

SEQ ID NO: 1182 - protein, 13 aa, Artificial Sequence
  Description of Artificial Sequence: Synthetic peptide
CGTWDKSLSGVVF

SEQ ID NO: 1183 - protein, 13 aa, Artificial Sequence
  Description of Artificial Sequence: Synthetic peptide
CGTWDKSLSDWVF

SEQ ID NO: 1184 - protein, 13 aa, Artificial Sequence
  Description of Artificial Sequence: Synthetic peptide
CGTWDKSLSALVF

SEQ ID NO: 1185 - protein, 13 aa, Artificial Sequence
  Description of Artificial Sequence: Synthetic peptide
CGTWDKSLSAGVF

SEQ ID NO: 1186 - protein, 13 aa, Artificial Sequence
  Description of Artificial Sequence: Synthetic peptide
CGTWDKSLSADVF

SEQ ID NO: 1187 - protein, 13 aa, Artificial Sequence
  Description of Artificial Sequence: Synthetic peptide
CGTWDKRLTIVVF

SEQ ID NO: 1188 - protein, 13 aa, Artificial Sequence
  Description of Artificial Sequence: Synthetic peptide
CGTWDKRLSAWVL

SEQ ID NO: 1189 - protein, 13 aa, Artificial Sequence
  Description of Artificial Sequence: Synthetic peptide
CGTWDKNLRAVVF

SEQ ID NO: 1190 - protein, 13 aa, Artificial Sequence
  Description of Artificial Sequence: Synthetic peptide
CGTWDITLSGFVF

SEQ ID NO: 1191 - protein, 13 aa, Artificial Sequence
  Description of Artificial Sequence: Synthetic peptide
CGTWDITLHTGVF

SEQ ID NO: 1192 - protein, 12 aa, Artificial Sequence
  Description of Artificial Sequence: Synthetic peptide
CGTWDISVTVVF

SEQ ID NO: 1193 - protein, 13 aa, Artificial Sequence
  Description of Artificial Sequence: Synthetic peptide
CGTWDISVRGYAF

SEQ ID NO: 1194 - protein, 11 aa, Artificial Sequence
  Description of Artificial Sequence: Synthetic peptide
CGTWDISRWVF

SEQ ID NO: 1195 - protein, 13 aa, Artificial Sequence
  Description of Artificial Sequence: Synthetic peptide
CGTWDISPSAWVF

SEQ ID NO: 1196 - protein, 13 aa, Artificial Sequence [sequence omitted]

SEQ ID NO: 1197 - protein, 12 aa, Artificial Sequence
  Description of Artificial Sequence: Synthetic peptide
CGTWDISLSVVF

SEQ ID NO: 1198 - protein, 13 aa, Artificial Sequence
  Description of Artificial Sequence: Synthetic peptide
CGTWDISLSSVVF

SEQ ID NO: 1199 - protein, 13 aa, Artificial Sequence
  Description of Artificial Sequence: Synthetic peptide
CGTWDISLSHWLF

SEQ ID NO: 1200 - protein, 13 aa, Artificial Sequence
  Description of Artificial Sequence: Synthetic peptide
CGTWDISLSGWVF

SEQ ID NO: 1201 - protein, 13 aa, Artificial Sequence
  Description of Artificial Sequence: Synthetic peptide
CGTWDISLSGRVF

SEQ ID NO: 1202 - protein, 13 aa, Artificial Sequence
  Description of Artificial Sequence: Synthetic peptide
CGTWDISLSAWAF

SEQ ID NO: 1203 - protein, 13 aa, Artificial Sequence [sequence omitted]

SEQ ID NO: 1204 - protein, 13 aa, Artificial Sequence
  Description of Artificial Sequence: Synthetic peptide
CGTWDISLSAVIF

SEQ ID NO: 1205 - protein, 12 aa, Artificial Sequence
  Description of Artificial Sequence: Synthetic peptide
CGTWDISLSAVF

SEQ ID NO: 1206 - protein, 13 aa, Artificial Sequence
  Description of Artificial Sequence: Synthetic peptide
CGTWDISLSARVF

SEQ ID NO: 1207 - protein, 13 aa, Artificial Sequence
  Description of Artificial Sequence: Synthetic peptide
CGTWDISLSALVF

SEQ ID NO: 1208 - protein, 13 aa, Artificial Sequence
  Description of Artificial Sequence: Synthetic peptide
CGTWDISLSAHVF

SEQ ID NO: 1209 - protein, 14 aa, Artificial Sequence
  Description of Artificial Sequence: Synthetic peptide
CGTWDISLSAGVVF

SEQ ID NO: 1210 - protein, 15 aa, Artificial Sequence
  Description of Artificial Sequence: Synthetic peptide
CGTWDISLSAGPYVF

SEQ ID NO: 1211 - protein, 14 aa, Artificial Sequence
  Description of Artificial Sequence: Synthetic peptide
CGTWDISLSAGGVF

SEQ ID NO: 1212 - protein, 13 aa, Artificial Sequence
  Description of Artificial Sequence: Synthetic peptide
CGTWDISLSAEVF

SEQ ID NO: 1213 - protein, 13 aa, Artificial Sequence
  Description of Artificial Sequence: Synthetic peptide
CGTWDISLSAAVF

SEQ ID NO: 1214 - protein, 12 aa, Artificial Sequence
  Description of Artificial Sequence: Synthetic peptide
CGTWDISLRAVF

SEQ ID NO: 1215 - protein, 13 aa, Artificial Sequence
  Description of Artificial Sequence: Synthetic peptide
CGTWDISLNTGVF

SEQ ID NO: 1216 - protein, 13 aa, Artificial Sequence
  Description of Artificial Sequence: Synthetic peptide
CGTWDISLNNYVF

SEQ ID NO: 1217 - protein, 13 aa, Artificial Sequence
  Description of Artificial Sequence: Synthetic peptide
CGTWDISLIAGVF

SEQ ID NO: 1218 - protein, 13 aa, Artificial Sequence
  Description of Artificial Sequence: Synthetic peptide
CGTWDISLHTWLF

SEQ ID NO: 1219 - protein, 14 aa, Artificial Sequence
  Description of Artificial Sequence: Synthetic peptide
CGTWDIRLTDELLF

SEQ ID NO: 1220 - protein, 13 aa, Artificial Sequence
  Description of Artificial Sequence: Synthetic peptide
CGTWDIRLSGFVF

SEQ ID NO: 1221 - protein, 16 aa, Artificial Sequence
  Description of Artificial Sequence: Synthetic peptide
CGTWDINLGAGGLYVF

SEQ ID NO: 1222 - protein, 13 aa, Artificial Sequence
  Description of Artificial Sequence: Synthetic peptide
CGTWDIILSAEVF

SEQ ID NO: 1223 - protein, 12 aa, Artificial Sequence
  Description of Artificial Sequence: Synthetic peptide
CGTWDHTLSAVF

SEQ ID NO: 1224 - protein, 13 aa, Artificial Sequence
  Description of Artificial Sequence: Synthetic peptide
CGTWDHTLLTVLF

SEQ ID NO: 1225 - protein, 13 aa, Artificial Sequence
  Description of Artificial Sequence: Synthetic peptide
CGTWDHSLTAVVF

SEQ ID NO: 1226 - protein, 13 aa, Artificial Sequence
  Description of Artificial Sequence: Synthetic peptide
CGTWDHSLTAGIF

SEQ ID NO: 1227 - protein, 13 aa, Artificial Sequence
  Description of Artificial Sequence: Synthetic peptide
CGTWDHSLSVVLF

SEQ ID NO: 1228 - protein, 12 aa, Artificial Sequence
  Description of Artificial Sequence: Synthetic peptide
CGTWDHSLSLVF

SEQ ID NO: 1229 - protein, 13 aa, Artificial Sequence
  Description of Artificial Sequence: Synthetic peptide
CGTWDHSLSIGVF

SEQ ID NO: 1230 - protein, 13 aa, Artificial Sequence [sequence omitted]

SEQ ID NO: 1231 - protein, 13 aa, Artificial Sequence
  Description of Artificial Sequence: Synthetic peptide
CGTWDHSLSAFVF

SEQ ID NO: 1232 - protein, 13 aa, Artificial Sequence
  Description of Artificial Sequence: Synthetic peptide
CGTWDHSLSAAVF

SEQ ID NO: 1233 - protein, 12 aa, Artificial Sequence
  Description of Artificial Sequence: Synthetic peptide
CGTWDHNLRAVF

SEQ ID NO: 1234 - protein, 13 aa, Artificial Sequence
  Description of Artificial Sequence: Synthetic peptide
CGTWDFTLSVGRF

SEQ ID NO: 1235 - protein, 13 aa, Artificial Sequence
  Description of Artificial Sequence: Synthetic peptide
CGTWDFTLSAPVF

SEQ ID NO: 1236 - protein, 14 aa, Artificial Sequence
  Description of Artificial Sequence: Synthetic peptide
CGTWDFSVSAGWVF

SEQ ID NO: 1237 - protein, 13 aa, Artificial Sequence
  Description of Artificial Sequence: Synthetic peptide
CGTWDFSLTTWLF

SEQ ID NO: 1238 - protein, 13 aa, Artificial Sequence
  Description of Artificial Sequence: Synthetic peptide
CGTWDFSLSVWVF

SEQ ID NO: 1239 - protein, 13 aa, Artificial Sequence
  Description of Artificial Sequence: Synthetic peptide
CGTWDFSLSTGVF

SEQ ID NO: 1240 - protein, 13 aa, Artificial Sequence
  Description of Artificial Sequence: Synthetic peptide
CGTWDFSLSGVVF

SEQ ID NO: 1241 - protein, 13 aa, Artificial Sequence
  Description of Artificial Sequence: Synthetic peptide
CGTWDFSLSGFVF

SEQ ID NO: 1242 - protein, 13 aa, Artificial Sequence [sequence omitted]

SEQ ID NO: 1243 - protein, 13 aa, Artificial Sequence
  Description of Artificial Sequence: Synthetic peptide
CGTWDETVRGWVF

SEQ ID NO: 1244 - protein, 13 aa, Artificial Sequence
  Description of Artificial Sequence: Synthetic peptide
CGTWDESLRSWVF

SEQ ID NO: 1245 - protein, 15 aa, Artificial Sequence
  Description of Artificial Sequence: Synthetic peptide
CGTWDERQTDESYVF

SEQ ID NO: 1246 - protein, 14 aa, Artificial Sequence
  Description of Artificial Sequence: Synthetic peptide
CGTWDERLVAGQVF

SEQ ID NO: 1247 - protein, 14 aa, Artificial Sequence
  Description of Artificial Sequence: Synthetic peptide
CGTWDERLSPGAFF

SEQ ID NO: 1248 - protein, 9 aa, Artificial Sequence
  Description of Artificial Sequence: Synthetic peptide
CGTWDEKVF

SEQ ID NO: 1249 - protein, 15 aa, Artificial Sequence
  Description of Artificial Sequence: Synthetic peptide
CGTWDEGQTTDFFVF

SEQ ID NO: 1250 - protein, 13 aa, Artificial Sequence
  Description of Artificial Sequence: Synthetic peptide
CGTWDDTLAGVVF

SEQ ID NO: 1251 - protein, 13 aa, Artificial Sequence
  Description of Artificial Sequence: Synthetic peptide
CGTWDDRLTSAVF

SEQ ID NO: 1252 - protein, 13 aa, Artificial Sequence
  Description of Artificial Sequence: Synthetic peptide
CGTWDDRLFVVVF

SEQ ID NO: 1253 - protein, 13 aa, Artificial Sequence
  Description of Artificial Sequence: Synthetic peptide
CGTWDDNLRGWVF

SEQ ID NO: 1254 - protein, 13 aa, Artificial Sequence
  Description of Artificial Sequence: Synthetic peptide
CGTWDDNLRGVVF

SEQ ID NO: 1255 - protein, 14 aa, Artificial Sequence
  Description of Artificial Sequence: Synthetic peptide
CGTWDDNLNIGRVF

SEQ ID NO: 1256 - protein, 13 aa, Artificial Sequence
  Description of Artificial Sequence: Synthetic peptide
CGTWDDILSAVIF

SEQ ID NO: 1257 - protein, 13 aa, Artificial Sequence
  Description of Artificial Sequence: Synthetic peptide
CGTWDDILRGWVF

SEQ ID NO: 1258 - protein, 14 aa, Artificial Sequence
  Description of Artificial Sequence: Synthetic peptide
CGTWDATLSPGWLF

SEQ ID NO: 1259 - protein, 13 aa, Artificial Sequence
  Description of Artificial Sequence: Synthetic peptide
CGTWDASVTSWVF

SEQ ID NO: 1260 - protein, 13 aa, Artificial Sequence
  Description of Artificial Sequence: Synthetic peptide
CGTWDASLTSVVF

SEQ ID NO: 1261 - protein, 13 aa, Artificial Sequence
  Description of Artificial Sequence: Synthetic peptide
CGTWDASLSVWVF

SEQ ID NO: 1262 - protein, 14 aa, Artificial Sequence
  Description of Artificial Sequence: Synthetic peptide
CGTWDASLSVPWVF

SEQ ID NO: 1263 - protein, 13 aa, Artificial Sequence
  Description of Artificial Sequence: Synthetic peptide
CGTWDASLSVAVF

SEQ ID NO: 1264 - protein, 13 aa, Artificial Sequence
  Description of Artificial Sequence: Synthetic peptide
CGTWDASLSTWVF

SEQ ID NO: 1265 - protein, 13 aa, Artificial Sequence
  Description of Artificial Sequence: Synthetic peptide
CGTWDASLSGVVF

SEQ ID NO: 1266 - protein, 14 aa, Artificial Sequence
  Description of Artificial Sequence: Synthetic peptide
CGTWDASLSGGGEF

SEQ ID NO: 1267 - protein, 13 aa, Artificial Sequence [sequence omitted]

SEQ ID NO: 1268 - protein, 13 aa, Artificial Sequence
  Description of Artificial Sequence: Synthetic peptide
CGTWDASLSAGLF

SEQ ID NO: 1269 - protein, 13 aa, Artificial Sequence [sequence omitted]

SEQ ID NO: 1270 - protein, 15 aa, Artificial Sequence
  Description of Artificial Sequence: Synthetic peptide
CGTWDASLSADFWVF

SEQ ID NO: 1271 - protein, 12 aa, Artificial Sequence
  Description of Artificial Sequence: Synthetic peptide
CGTWDASLRVFF

SEQ ID NO: 1272 - protein, 13 aa, Artificial Sequence
  Description of Artificial Sequence: Synthetic peptide
CGTWDASLRAVVL

SEQ ID NO: 1273 - protein, 13 aa, Artificial Sequence
  Description of Artificial Sequence: Synthetic peptide
CGTWDASLNIWVF

SEQ ID NO: 1274 - protein, 13 aa, Artificial Sequence
  Description of Artificial Sequence: Synthetic peptide
CGTWDASLKNLVF

SEQ ID NO: 1275 - protein, 13 aa, Artificial Sequence
  Description of Artificial Sequence: Synthetic peptide
CGTWDASLGAWVF

SEQ ID NO: 1276 - protein, 13 aa, Artificial Sequence
  Description of Artificial Sequence: Synthetic peptide
CGTWDASLGAVVF

SEQ ID NO: 1277 - protein, 13 aa, Artificial Sequence
  Description of Artificial Sequence: Synthetic peptide
CGTWDASLGAGVF

SEQ ID NO: 1278 - protein, 14 aa, Artificial Sequence
  Description of Artificial Sequence: Synthetic peptide
CGTWDARLSGLYVF

SEQ ID NO: 1279 - protein, 13 aa, Artificial Sequence
  Description of Artificial Sequence: Synthetic peptide
CGTWDARLGGAVF

SEQ ID NO: 1280 - protein, 13 aa, Artificial Sequence
  Description of Artificial Sequence: Synthetic peptide
CGTWDANLRAGVF

SEQ ID NO: 1281 - protein, 13 aa, Artificial Sequence
  Description of Artificial Sequence: Synthetic peptide
CGTWDAIISGWVF

SEQ ID NO: 1282 - protein, 13 aa, Artificial Sequence
  Description of Artificial Sequence: Synthetic peptide
CGTWDAGQSVWVF

SEQ ID NO: 1283 - protein, 14 aa, Artificial Sequence
  Description of Artificial Sequence: Synthetic peptide
CGTWDAGLTGLYVF

SEQ ID NO: 1284 - protein, 13 aa, Artificial Sequence
  Description of Artificial Sequence: Synthetic peptide
CGTWDAGLSVYVF

SEQ ID NO: 1285 - protein, 13 aa, Artificial Sequence
  Description of Artificial Sequence: Synthetic peptide
CGTWDAGLSTGVF

SEQ ID NO: 1286 - protein, 13 aa, Artificial Sequence
  Description of Artificial Sequence: Synthetic peptide
CGTWDAGLSGDVF

SEQ ID NO: 1287 - protein, 14 aa, Artificial Sequence
  Description of Artificial Sequence: Synthetic peptide
CGTWDAGLSAGYVF

SEQ ID NO: 1288 - protein, 13 aa, Artificial Sequence
  Description of Artificial Sequence: Synthetic peptide
CGTWDAGLRVWVF

SEQ ID NO: 1289 - protein, 12 aa, Artificial Sequence
  Description of Artificial Sequence: Synthetic peptide
CGTWDAGLREIF

SEQ ID NO: 1290 - protein, 13 aa, Artificial Sequence
  Description of Artificial Sequence: Synthetic peptide
CGTWASSLSSWVF

SEQ ID NO: 1291 - protein, 13 aa, Artificial Sequence
  Description of Artificial Sequence: Synthetic peptide
CGTWAGSLSGHVF

SEQ ID NO: 1292 - protein, 14 aa, Artificial Sequence
  Description of Artificial Sequence: Synthetic peptide
CGTWAGSLSAAWVF

SEQ ID NO: 1293 - protein, 14 aa, Artificial Sequence
  Description of Artificial Sequence: Synthetic peptide
CGTWAGSLNVYWVF

SEQ ID NO: 1294 - protein, 14 aa, Artificial Sequence
  Description of Artificial Sequence: Synthetic peptide
CGTWAGNLRPNWVF

SEQ ID NO: 1295 - protein, 12 aa, Artificial Sequence
  Description of Artificial Sequence: Synthetic peptide
CGTRGSLGGAVF

SEQ ID NO: 1296 - protein, 13 aa, Artificial Sequence
  Description of Artificial Sequence: Synthetic peptide
CGTRDTTLSVPVF

SEQ ID NO: 1297 - protein, 13 aa, Artificial Sequence
  Description of Artificial Sequence: Synthetic peptide
CGTRDTSLNIEIF

SEQ ID NO: 1298 - protein, 12 aa, Artificial Sequence
  Description of Artificial Sequence: Synthetic peptide
CGTRDTSLNDVF

SEQ ID NO: 1299 - protein, 13 aa, Artificial Sequence
  Description of Artificial Sequence: Synthetic peptide
CGTRDTRLSIVVF

SEQ ID NO: 1300 - protein, 13 aa, Artificial Sequence
  Description of Artificial Sequence: Synthetic peptide
CGTRDTILSAEVF

SEQ ID NO: 1301 - protein, 13 aa, Artificial Sequence
  Description of Artificial Sequence: Synthetic peptide
CGTRDRSLSGWVF

SEQ ID NO: 1302 - protein, 11 aa, Artificial Sequence
  Description of Artificial Sequence: Synthetic peptide
CGSWYYNVFLF

SEQ ID NO: 1303 - protein, 13 aa, Artificial Sequence
  Description of Artificial Sequence: Synthetic peptide
CGSWHSSLNLVVF

SEQ ID NO: 1304 - protein, 14 aa, Artificial Sequence
  Description of Artificial Sequence: Synthetic peptide
CGSWGSGLSAPYVF

SEQ ID NO: 1305 - protein, 13 aa, Artificial Sequence
  Description of Artificial Sequence: Synthetic peptide
CGSWESGLGAWLF

SEQ ID NO: 1306 - protein, 11 aa, Artificial Sequence
  Description of Artificial Sequence: Synthetic peptide
CGSWDYGLLLF

SEQ ID NO: 1307 - protein, 12 aa, Artificial Sequence
  Description of Artificial Sequence: Synthetic peptide
CGSWDVSLTAVF

SEQ ID NO: 1308 - protein, 13 aa, Artificial Sequence
  Description of Artificial Sequence: Synthetic peptide
CGSWDVSLNVGIF

SEQ ID NO: 1309 - protein, 13 aa, Artificial Sequence
  Description of Artificial Sequence: Synthetic peptide
CGSWDTTLRAWVF

SEQ ID NO: 1310 - protein, 14 aa, Artificial Sequence
  Description of Artificial Sequence: Synthetic peptide
CGSWDTSPVRAWVF

SEQ ID NO: 1311 - protein, 13 aa, Artificial Sequence
  Description of Artificial Sequence: Synthetic peptide
CGSWDTSLSVWVF

SEQ ID NO: 1312 - protein, 13 aa, Artificial Sequence
  Description of Artificial Sequence: Synthetic peptide
CGSWDTSLSAEVF

SEQ ID NO: 1313 - protein, 13 aa, Artificial Sequence
  Description of Artificial Sequence: Synthetic peptide
CGSWDTSLRAWVF

SEQ ID NO: 1314 - protein, 13 aa, Artificial Sequence
  Description of Artificial Sequence: Synthetic peptide
CGSWDTSLRAWAF

SEQ ID NO: 1315 - protein, 13 aa, Artificial Sequence
  Description of Artificial Sequence: Synthetic peptide
CGSWDTSLDARLF

SEQ ID NO: 1316 - protein, 13 aa, Artificial Sequence
  Description of Artificial Sequence: Synthetic peptide
CGSWDTILLVYVF

SEQ ID NO: 1317 - protein, 12 aa, Artificial Sequence
  Description of Artificial Sequence: Synthetic peptide
CGSWDRWQAAVF

SEQ ID NO: 1318 - protein, 13 aa, Artificial Sequence
  Description of Artificial Sequence: Synthetic peptide
CGSWDRSLSGYVF

SEQ ID NO: 1319 - protein, 13 aa, Artificial Sequence
  Description of Artificial Sequence: Synthetic peptide
CGSWDRSLSAYVF

SEQ ID NO: 1320 - protein, 13 aa, Artificial Sequence
  Description of Artificial Sequence: Synthetic peptide
CGSWDRSLSAVVF

SEQ ID NO: 1321 - protein, 13 aa, Artificial Sequence
  Description of Artificial Sequence: Synthetic peptide
CGSWDNTLGVVLF

SEQ ID NO: 1322 - protein, 13 aa, Artificial Sequence
  Description of Artificial Sequence: Synthetic peptide
CGSWDNRLSTVIF

SEQ ID NO: 1323 - protein, 13 aa, Artificial Sequence
  Description of Artificial Sequence: Synthetic peptide
CGSWDNRLNTVIF

SEQ ID NO: 1324 - protein, 14 aa, Artificial Sequence
  Description of Artificial Sequence: Synthetic peptide
CGSWDLSPVRVLVF

SEQ ID NO: 1325 - protein, 13 aa, Artificial Sequence
  Description of Artificial Sequence: Synthetic peptide
CGSWDLSLSAVVF

SEQ ID NO: 1326 - protein, 13 aa, Artificial Sequence
  Description of Artificial Sequence: Synthetic peptide
CGSWDKNLRAVLF

SEQ ID NO: 1327 - protein, 13 aa, Artificial Sequence
  Description of Artificial Sequence: Synthetic peptide
CGSWDISLSAGVF

SEQ ID NO: 1328 - protein, 13 aa, Artificial Sequence
  Description of Artificial Sequence: Synthetic peptide
CGSWDIRLSAEVF

SEQ ID NO: 1329 - protein, 13 aa, Artificial Sequence
  Description of Artificial Sequence: Synthetic peptide
CGSWDIKLNIGVF

SEQ ID NO: 1330 - protein, 13 aa, Artificial Sequence
  Description of Artificial Sequence: Synthetic peptide
CGSWDFSLNYFVF

SEQ ID NO: 1331 - protein, 13 aa, Artificial Sequence
  Description of Artificial Sequence: Synthetic peptide
CGSWDASLSTEVF

SEQ ID NO: 1332 - protein, 13 aa, Artificial Sequence
  Description of Artificial Sequence: Synthetic peptide
CGSWDAGLRGWVF

SEQ ID NO: 1333 - protein, 13 aa, Artificial Sequence
  Description of Artificial Sequence: Synthetic peptide
CGRWESSLGAVVF

SEQ ID NO: 1334 - protein, 13 aa, Artificial Sequence
  Description of Artificial Sequence: Synthetic peptide
CGRWDFSLSAYVF

SEQ ID NO: 1335 - protein, 13 aa, Artificial Sequence
  Description of Artificial Sequence: Synthetic peptide
CGQWDNDLSVWVF

SEQ ID NO: 1336 - protein, 14 aa, Artificial Sequence
  Description of Artificial Sequence: Synthetic peptide
CGPWHSSVTSGHVL

SEQ ID NO: 1337 - protein, 15 aa, Artificial Sequence
  Description of Artificial Sequence: Synthetic peptide
CGLWDASLSAPTWVF

SEQ ID NO: 1338 - protein, 13 aa, Artificial Sequence
  Description of Artificial Sequence: Synthetic peptide
CGIWHTSLSAWVF

SEQ ID NO: 1339 - protein, 13 aa, Artificial Sequence
  Description of Artificial Sequence: Synthetic peptide
CGIWDYSLDTWVF

SEQ ID NO: 1340 - protein, 13 aa, Artificial Sequence
  Description of Artificial Sequence: Synthetic peptide
CGIWDTSLSAWVF

SEQ ID NO: 1341 - protein, 13 aa, Artificial Sequence
  Description of Artificial Sequence: Synthetic peptide
CGIWDTRLSVYVF

SEQ ID NO: 1342 - protein, 13 aa, Artificial Sequence
  Description of Artificial Sequence: Synthetic peptide
CGIWDTRLSVYIF

SEQ ID NO: 1343 - protein, 12 aa, Artificial Sequence
  Description of Artificial Sequence: Synthetic peptide
CGIWDTNLGYLF

SEQ ID NO: 1344 - protein, 13 aa, Artificial Sequence
  Description of Artificial Sequence: Synthetic peptide
CGIWDTGLSAVVF

SEQ ID NO: 1345 - protein, 13 aa, Artificial Sequence
  Description of Artificial Sequence: Synthetic peptide
CGIWDRSLSAWVF

SEQ ID NO: 1346 - protein, 13 aa, Artificial Sequence
  Description of Artificial Sequence: Synthetic peptide
CGIRDTRLSVYVF

SEQ ID NO: 1347 - protein, 14 aa, Artificial Sequence
  Description of Artificial Sequence: Synthetic peptide
CGGWSSRLGVGPVF

SEQ ID NO: 1348 - protein, 13 aa, Artificial Sequence
  Description of Artificial Sequence: Synthetic peptide
CGGWGSGLSAWVF

SEQ ID NO: 1349 - protein, 13 aa, Artificial Sequence
  Description of Artificial Sequence: Synthetic peptide
CGGWDTSLSAWVF

SEQ ID NO: 1350 - protein, 13 aa, Artificial Sequence
  Description of Artificial Sequence: Synthetic peptide
CGGWDRGLDAWVF

SEQ ID NO: 1351 - protein, 11 aa, Artificial Sequence
  Description of Artificial Sequence: Synthetic peptide
CGAWRNNVWVF

SEQ ID NO: 1352 - protein, 16 aa, Artificial Sequence
  Description of Artificial Sequence: Synthetic peptide
CGAWNRRLNPHSHWVF

SEQ ID NO: 1353 - protein, 12 aa, Artificial Sequence
  Description of Artificial Sequence: Synthetic peptide
CGAWHNKLSAVF

SEQ ID NO: 1354 - protein, 13 aa, Artificial Sequence
  Description of Artificial Sequence: Synthetic peptide
CGAWGSSLRASVF

SEQ ID NO: 1355 - protein, 13 aa, Artificial Sequence
  Description of Artificial Sequence: Synthetic peptide
CGAWGSGLSAWVF

SEQ ID NO: 1356 - protein, 14 aa, Artificial Sequence
  Description of Artificial Sequence: Synthetic peptide
CGAWESSLSAPYVF

SEQ ID NO: 1357 - protein, 13 aa, Artificial Sequence
  Description of Artificial Sequence: Synthetic peptide
CGAWESSLNVGLI

SEQ ID NO: 1358 - protein, 14 aa, Artificial Sequence
  Description of Artificial Sequence: Synthetic peptide
CGAWESGRSAGVVF

SEQ ID NO: 1359 - protein, 13 aa, Artificial Sequence
  Description of Artificial Sequence: Synthetic peptide
CGAWDYSVSGWVF

SEQ ID NO: 1360 - protein, 13 aa, Artificial Sequence
  Description of Artificial Sequence: Synthetic peptide
CGAWDYSLTAGVF

SEQ ID NO: 1361 - protein, 13 aa, Artificial Sequence
  Description of Artificial Sequence: Synthetic peptide
CGAWDYRLSAVLF

SEQ ID NO: 1362 - protein, 13 aa, Artificial Sequence
  Description of Artificial Sequence: Synthetic peptide
CGAWDVRLDVGVF

SEQ ID NO: 1363 - protein, 11 aa, Artificial Sequence
  Description of Artificial Sequence: Synthetic peptide
CGAWDTYSYVF

SEQ ID NO: 1364 - protein, 13 aa, Artificial Sequence
  Description of Artificial Sequence: Synthetic peptide
CGAWDTTLSGVVF

SEQ ID NO: 1365 - protein, 13 aa, Artificial Sequence
  Description of Artificial Sequence: Synthetic peptide
CGAWDTTLSAVIF

SEQ ID NO: 1366 - protein, 14 aa, Artificial Sequence
  Description of Artificial Sequence: Synthetic peptide
CGAWDTSQGASYVF

SEQ ID NO: 1367 - protein, 14 aa, Artificial Sequence
  Description of Artificial Sequence: Synthetic peptide
CGAWDTSPVRAGVF

SEQ ID NO: 1368 - protein, 11 aa, Artificial Sequence
  Description of Artificial Sequence: Synthetic peptide
CGAWDTSLWLF

SEQ ID NO: 1369 - protein, 13 aa, Artificial Sequence
  Description of Artificial Sequence: Synthetic peptide
CGAWDTSLTVYVF

SEQ ID NO: 1370 - protein, 13 aa, Artificial Sequence
  Description of Artificial Sequence: Synthetic peptide
CGAWDTSLTAGVF

SEQ ID NO: 1371 - protein, 13 aa, Artificial Sequence
  Description of Artificial Sequence: Synthetic peptide
CGAWDTSLSTVVF

SEQ ID NO: 1372 - protein, 14 aa, Artificial Sequence
  Description of Artificial Sequence: Synthetic peptide
CGAWDTSLSSRYIF

SEQ ID NO: 1373 - protein, 13 aa, Artificial Sequence
  Description of Artificial Sequence: Synthetic peptide
CGAWDTSLSGYVF

SEQ ID NO: 1374 - protein, 13 aa, Artificial Sequence
  Description of Artificial Sequence: Synthetic peptide
CGAWDTSLSGWVF

SEQ ID NO: 1375 - protein, 13 aa, Artificial Sequence
  Description of Artificial Sequence: Synthetic peptide
CGAWDTSLSGVLF

SEQ ID NO: 1376 - protein, 13 aa, Artificial Sequence
  Description of Artificial Sequence: Synthetic peptide
CGAWDTSLSGLVF

SEQ ID NO: 1377 - protein, 13 aa, Artificial Sequence
  Description of Artificial Sequence: Synthetic peptide
CGAWDTSLSGFVF

SEQ ID NO: 1378 - protein, 13 aa, Artificial Sequence
  Description of Artificial Sequence: Synthetic peptide
CGAWDTSLSGEVF

SEQ ID NO: 1379 - protein, 13 aa, Artificial Sequence
  Description of Artificial Sequence: Synthetic peptide
CGAWDTSLSDFVF

SEQ ID NO: 1380 - protein, 13 aa, Artificial Sequence
  Description of Artificial Sequence: Synthetic peptide
CGAWDTSLRTAIF

SEQ ID NO: 1381 - protein, 11 aa, Artificial Sequence
  Description of Artificial Sequence: Synthetic peptide
CGAWDTSLRLF

SEQ ID NO: 1382 - protein, 13 aa, Artificial Sequence
  Description of Artificial Sequence: Synthetic peptide
CGAWDTSLNVHVF

SEQ ID NO: 1383 - protein, 13 aa, Artificial Sequence
  Description of Artificial Sequence: Synthetic peptide
CGAWDTSLNKWVF

SEQ ID NO: 1384 - protein, 13 aa, Artificial Sequence
  Description of Artificial Sequence: Synthetic peptide
CGAWDTRLSARLF

SEQ ID NO: 1385 - protein, 13 aa, Artificial Sequence
  Description of Artificial Sequence: Synthetic peptide
CGAWDTRLRGFIF

SEQ ID NO: 1386 - protein, 13 aa, Artificial Sequence
  Description of Artificial Sequence: Synthetic peptide
CGAWDTNLGNVLL

SEQ ID NO: 1387 - protein, 13 aa, Artificial Sequence
  Description of Artificial Sequence: Synthetic peptide
CGAWDTNLGKWVF

SEQ ID NO: 1388 - protein, 13 aa, Artificial Sequence
  Description of Artificial Sequence: Synthetic peptide
CGAWDTGLEWYVF

SEQ ID NO: 1389 - protein, 13 aa, Artificial Sequence
  Description of Artificial Sequence: Synthetic peptide
CGAWDRTSGLWLF

SEQ ID NO: 1390 - protein, 13 aa, Artificial Sequence
  Description of Artificial Sequence: Synthetic peptide
CGAWDRSLVAGLF

SEQ ID NO: 1391 - protein, 13 aa, Artificial Sequence
  Description of Artificial Sequence: Synthetic peptide
CGAWDRSLTVYVF

SEQ ID NO: 1392 - protein, 13 aa, Artificial Sequence
  Description of Artificial Sequence: Synthetic peptide
CGAWDRSLSGYVF

SEQ ID NO: 1393 - protein, 13 aa, Artificial Sequence
  Description of Artificial Sequence: Synthetic peptide
CGAWDRSLSAYVF

SEQ ID NO: 1394 - protein, 13 aa, Artificial Sequence [sequence omitted]

SEQ ID NO: 1395 - protein, 13 aa, Artificial Sequence
  Description of Artificial Sequence: Synthetic peptide
CGAWDRSLSAGVF

SEQ ID NO: 1396 - protein, 13 aa, Artificial Sequence
  Description of Artificial Sequence: Synthetic peptide
CGAWDRSLRIVVF

SEQ ID NO: 1397 - protein, 13 aa, Artificial Sequence
  Description of Artificial Sequence: Synthetic peptide
CGAWDRSLRAYVF

SEQ ID NO: 1398 - protein, 13 aa, Artificial Sequence
  Description of Artificial Sequence: Synthetic peptide
CGAWDRSLNVWLF

SEQ ID NO: 1399 - protein, 14 aa, Artificial Sequence
  Description of Artificial Sequence: Synthetic peptide
CGAWDRGLNVGWLF

SEQ ID NO: 1400 - protein, 13 aa, Artificial Sequence
  Description of Artificial Sequence: Synthetic peptide
CGAWDNRLSILAF

SEQ ID NO: 1401 - protein, 13 aa, Artificial Sequence
  Description of Artificial Sequence: Synthetic peptide
CGAWDNDLTAYVF

SEQ ID NO: 1402 - protein, 12 aa, Artificial Sequence
  Description of Artificial Sequence: Synthetic peptide
CGAWDFSLTPLF

SEQ ID NO: 1403 - protein, 15 aa, Artificial Sequence
  Description of Artificial Sequence: Synthetic peptide
CGAWDDYRGVSIYVF

SEQ ID NO: 1404 - protein, 14 aa, Artificial Sequence
  Description of Artificial Sequence: Synthetic peptide
CGAWDDRPSSAVVF

SEQ ID NO: 1405 - protein, 13 aa, Artificial Sequence
  Description of Artificial Sequence: Synthetic peptide
CGAWDDRLTVVVF

SEQ ID NO: 1406 - protein, 12 aa, Artificial Sequence
  Description of Artificial Sequence: Synthetic peptide
CGAWDDRLGAVF

SEQ ID NO: 1407 - protein, 14 aa, Artificial Sequence
  Description of Artificial Sequence: Synthetic peptide
CGAWDASLNPGRAF

SEQ ID NO: 1408 - protein, 12 aa, Artificial Sequence
  Description of Artificial Sequence: Synthetic peptide
CGAWDAGLREIF

SEQ ID NO: 1409 - protein, 13 aa, Artificial Sequence
  Description of Artificial Sequence: Synthetic peptide
CGAWAGSPSPWVF

SEQ ID NO: 1410 - protein, 13 aa, Artificial Sequence
  Description of Artificial Sequence: Synthetic peptide
CGAFDTTLSAGVF

SEQ ID NO: 1411 - protein, 13 aa, Artificial Sequence
  Description of Artificial Sequence: Synthetic peptide
CETWESSLSVGVF

SEQ ID NO: 1412 - protein, 13 aa, Artificial Sequence
  Description of Artificial Sequence: Synthetic peptide
CETWESSLRVWVF

SEQ ID NO: 1413 - protein, 13 aa, Artificial Sequence
  Description of Artificial Sequence: Synthetic peptide
CETWDTSLSGGVF

SEQ ID NO: 1414 - protein, 14 aa, Artificial Sequence
  Description of Artificial Sequence: Synthetic peptide
CETWDTSLSDFYVF

SEQ ID NO: 1415 - protein, 12 aa, Artificial Sequence
  Description of Artificial Sequence: Synthetic peptide
CETWDTSLSALF

SEQ ID NO: 1416 - protein, 13 aa, Artificial Sequence [sequence omitted]

SEQ ID NO: 1417 - protein, 13 aa, Artificial Sequence
  Description of Artificial Sequence: Synthetic peptide
CETWDTSLNVVVF

SEQ ID NO: 1418 - protein, 13 aa, Artificial Sequence
  Description of Artificial Sequence: Synthetic peptide
CETWDTSLGAVVF

SEQ ID NO: 1419 - protein, 13 aa, Artificial Sequence
  Description of Artificial Sequence: Synthetic peptide
CETWDRSLSGVVF

SEQ ID NO: 1420 - protein, 13 aa, Artificial Sequence
  Description of Artificial Sequence: Synthetic peptide
CETWDRSLSAWVF

SEQ ID NO: 1421 - protein, 13 aa, Artificial Sequence [sequence omitted]

SEQ ID NO: 1422 - protein, 13 aa, Artificial Sequence
  Description of Artificial Sequence: Synthetic peptide
CETWDRGLSVVVF

SEQ ID NO: 1423 - protein, 13 aa, Artificial Sequence
  Description of Artificial Sequence: Synthetic peptide
CETWDRGLSAVVF

SEQ ID NO: 1424 - protein, 13 aa, Artificial Sequence
  Description of Artificial Sequence: Synthetic peptide
CETWDHTLSVVIF

SEQ ID NO: 1425 - protein, 13 aa, Artificial Sequence
  Description of Artificial Sequence: Synthetic peptide
CETWDASLTVVLF

SEQ ID NO: 1426 - protein, 13 aa, Artificial Sequence
  Description of Artificial Sequence: Synthetic peptide
CETWDASLSAGVF

SEQ ID NO: 1427 - protein, 13 aa, Artificial Sequence
  Description of Artificial Sequence: Synthetic peptide
CETWDAGLSEVVF

SEQ ID NO: 1428 - protein, 13 aa, Artificial Sequence
  Description of Artificial Sequence: Synthetic peptide
CETFDTSLSVVVF

SEQ ID NO: 1429 - protein, 13 aa, Artificial Sequence
  Description of Artificial Sequence: Synthetic peptide
CETFDTSLNIVVF

SEQ ID NO: 1430 - protein, 13 aa, Artificial Sequence
  Description of Artificial Sequence: Synthetic peptide
CESWDRSRIGVVF

SEQ ID NO: 1431 - protein, 13 aa, Artificial Sequence
  Description of Artificial Sequence: Synthetic peptide
CESWDRSLSARVY

SEQ ID NO: 1432 - protein, 13 aa, Artificial Sequence
  Description of Artificial Sequence: Synthetic peptide
CESWDRSLRAVVF

SEQ ID NO: 1433 - protein, 12 aa, Artificial Sequence
  Description of Artificial Sequence: Synthetic peptide
CESWDRSLIVVF

SEQ ID NO: 1434 - protein, 13 aa, Artificial Sequence
  Description of Artificial Sequence: Synthetic peptide
CESWDNNLNEVVF

SEQ ID NO: 1435 - protein, 15 aa, Artificial Sequence
  Description of Artificial Sequence: Synthetic peptide
CEIWESSPSADDLVF

SEQ ID NO: 1436 - protein, 13 aa, Artificial Sequence
  Description of Artificial Sequence: Synthetic peptide
CEAWDTSLSGAVF

SEQ ID NO: 1437 - protein, 13 aa, Artificial Sequence
  Description of Artificial Sequence: Synthetic peptide
CEAWDTSLSAGVF

SEQ ID NO: 1438 - protein, 13 aa, Artificial Sequence
  Description of Artificial Sequence: Synthetic peptide
CEAWDTSLGGGVF

SEQ ID NO: 1439 - protein, 13 aa, Artificial Sequence
  Description of Artificial Sequence: Synthetic peptide
CEAWDRSLTGSLF

SEQ ID NO: 1440 - protein, 13 aa, Artificial Sequence
  Description of Artificial Sequence: Synthetic peptide
CEAWDRGLSAVVF

SEQ ID NO: 1441 - protein, 13 aa, Artificial Sequence
  Description of Artificial Sequence: Synthetic peptide
CEAWDNILSTVVF

SEQ ID NO: 1442 - protein, 13 aa, Artificial Sequence
  Description of Artificial Sequence: Synthetic peptide
CEAWDISLSAGVF

SEQ ID NO: 1443 - protein, 13 aa, Artificial Sequence
  Description of Artificial Sequence: Synthetic peptide
CEAWDADLSGAVF

SEQ ID NO: 1444 - protein, 15 aa, Artificial Sequence
  Description of Artificial Sequence: Synthetic peptide
CATWTGSFRTGHYVF

SEQ ID NO: 1445 - protein, 13 aa, Artificial Sequence
  Description of Artificial Sequence: Synthetic peptide
CATWSSSPRGWVF

SEQ ID NO: 1446 - protein, 14 aa, Artificial Sequence
  Description of Artificial Sequence: Synthetic peptide
CATWHYSLSAGRVF

SEQ ID NO: 1447 - protein, 13 aa, Artificial Sequence
  Description of Artificial Sequence: Synthetic peptide
CATWHTSLSIVQF

SEQ ID NO: 1448 - protein, 14 aa, Artificial Sequence
  Description of Artificial Sequence: Synthetic peptide
CATWHSTLSADVLF

SEQ ID NO: 1449 - protein, 14 aa, Artificial Sequence
  Description of Artificial Sequence: Synthetic peptide
CATWHSSLSAGRLF

SEQ ID NO: 1450 - protein, 13 aa, Artificial Sequence
  Description of Artificial Sequence: Synthetic peptide
CATWHIARSAWVF

SEQ ID NO: 1451 - protein, 13 aa, Artificial Sequence
  Description of Artificial Sequence: Synthetic peptide
CATWGSSQSAVVF

SEQ ID NO: 1452 - protein, 14 aa, Artificial Sequence
  Description of Artificial Sequence: Synthetic peptide
CATWGSSLSAGGVF

SEQ ID NO: 1453 - protein, 13 aa, Artificial Sequence
  Description of Artificial Sequence: Synthetic peptide
CATWEYSLSVVLF

SEQ ID NO: 1454 - protein, 14 aa, Artificial Sequence
  Description of Artificial Sequence: Synthetic peptide
CATWETTRRASFVF

SEQ ID NO: 1455 - protein, 13 aa, Artificial Sequence
  Description of Artificial Sequence: Synthetic peptide
CATWETSLNVYVF

SEQ ID NO: 1456 - protein, 13 aa, Artificial Sequence
  Description of Artificial Sequence: Synthetic peptide
CATWETSLNVVVF

SEQ ID NO: 1457 - protein, 13 aa, Artificial Sequence
  Description of Artificial Sequence: Synthetic peptide
CATWETSLNLYVF

SEQ ID NO: 1458 - protein, 14 aa, Artificial Sequence
  Description of Artificial Sequence: Synthetic peptide
CATWETGLSAGEVF

SEQ ID NO: 1459 - protein, 13 aa, Artificial Sequence
  Description of Artificial Sequence: Synthetic peptide
CATWESTLSVVVF

SEQ ID NO: 1460 - protein, 13 aa, Artificial Sequence
  Description of Artificial Sequence: Synthetic peptide
CATWESSLSIFVF

SEQ ID NO: 1461 - protein, 14 aa, Artificial Sequence
  Description of Artificial Sequence: Synthetic peptide
CATWESSLNTFYVF

SEQ ID NO: 1462 - protein, 15 aa, Artificial Sequence
  Description of Artificial Sequence: Synthetic peptide
CATWESRVDTRGLLF

SEQ ID NO: 1463 - protein, 14 aa, Artificial Sequence
  Description of Artificial Sequence: Synthetic peptide
CATWESGLSGAGVF

SEQ ID NO: 1464 - protein, 14 aa, Artificial Sequence
  Description of Artificial Sequence: Synthetic peptide
CATWEGSLNTFYVF

SEQ ID NO: 1465 - protein, 13 aa, Artificial Sequence [sequence omitted]

SEQ ID NO: 1466 - protein, 13 aa, Artificial Sequence
  Description of Artificial Sequence: Synthetic peptide
CATWDYRLSIVVF

SEQ ID NO: 1467 - protein, 13 aa, Artificial Sequence
  Description of Artificial Sequence: Synthetic peptide
CATWDYNLGAAVF

SEQ ID NO: 1468 - protein, 13 aa, Artificial Sequence
  Description of Artificial Sequence: Synthetic peptide
CATWDVTLGVLHF

SEQ ID NO: 1469 - protein, 13 aa, Artificial Sequence
  Description of Artificial Sequence: Synthetic peptide
CATWDTTLSVWVF

SEQ ID NO: 1470 - protein, 13 aa, Artificial Sequence
  Description of Artificial Sequence: Synthetic peptide
CATWDTTLSVVLF

SEQ ID NO: 1471 - protein, 13 aa, Artificial Sequence
  Description of Artificial Sequence: Synthetic peptide
CATWDTTLSVEVF

SEQ ID NO: 1472 - protein, 16 aa, Artificial Sequence
  Description of Artificial Sequence: Synthetic peptide
CATWDTSPSLSGFWVF

SEQ ID NO: 1473 - protein, 13 aa, Artificial Sequence
  Description of Artificial Sequence: Synthetic peptide
CATWDTSLTGVVF

SEQ ID NO: 1474 - protein, 13 aa, Artificial Sequence
  Description of Artificial Sequence: Synthetic peptide
CATWDTSLTGAVF

SEQ ID NO: 1475 - protein, 13 aa, Artificial Sequence
  Description of Artificial Sequence: Synthetic peptide
CATWDTSLTAWVF

SEQ ID NO: 1476 - protein, 13 aa, Artificial Sequence
  Description of Artificial Sequence: Synthetic peptide
CATWDTSLTAVVF

SEQ ID NO: 1477 - protein, 13 aa, Artificial Sequence
  Description of Artificial Sequence: Synthetic peptide
CATWDTSLTAKVF

SEQ ID NO: 1478 - protein, 13 aa, Artificial Sequence
  Description of Artificial Sequence: Synthetic peptide
CATWDTSLSVVVF

SEQ ID NO: 1479 - protein, 13 aa, Artificial Sequence [sequence omitted]

SEQ ID NO: 1480 - protein, 13 aa, Artificial Sequence
  Description of Artificial Sequence: Synthetic peptide
CATWDTSLSSWVF

SEQ ID NO: 1481 - protein, 13 aa, Artificial Sequence
  Description of Artificial Sequence: Synthetic peptide
CATWDTSLSGGVL

SEQ ID NO: 1482 - protein, 13 aa, Artificial Sequence [sequence omitted]

SEQ ID NO: 1483 - protein, 14 aa, Artificial Sequence
  Description of Artificial Sequence: Synthetic peptide
CATWDTSLSGGRVF

SEQ ID NO: 1484 - protein, 14 aa, Artificial Sequence
  Description of Artificial Sequence: Synthetic peptide
CATWDTSLSGDRVF

SEQ ID NO: 1485 - protein, 13 aa, Artificial Sequence
  Description of Artificial Sequence: Synthetic peptide
CATWDTSLSEGVF

SEQ ID NO: 1486 - protein, 13 aa, Artificial Sequence
  Description of Artificial Sequence: Synthetic peptide
CATWDTSLSAVVL

SEQ ID NO: 1487 - protein, 12 aa, Artificial Sequence
  Description of Artificial Sequence: Synthetic peptide
CATWDTSLSAVF

SEQ ID NO: 1488 - protein, 13 aa, Artificial Sequence
  Description of Artificial Sequence: Synthetic peptide
CATWDTSLSARVF

SEQ ID NO: 1489 - protein, 12 aa, Artificial Sequence
  Description of Artificial Sequence: Synthetic peptide
CATWDTSLSALF

SEQ ID NO: 1490 - protein, 13 aa, Artificial Sequence
  Description of Artificial Sequence: Synthetic peptide
CATWDTSLSAHVF

SEQ ID NO: 1491 - protein, 14 aa, Artificial Sequence
  Description of Artificial Sequence: Synthetic peptide
CATWDTSLSAGRVF

SEQ ID NO: 1492 - protein, 13 aa, Artificial Sequence
  Description of Artificial Sequence: Synthetic peptide
CATWDTSLSAEVF

SEQ ID NO: 1493 - protein, 17 aa, Artificial Sequence
  Description of Artificial Sequence: Synthetic peptide
CATWDTSLSADAGGGVF

SEQ ID NO: 1494 - protein, 13 aa, Artificial Sequence
  Description of Artificial Sequence: Synthetic peptide
CATWDTSLRVVVF

SEQ ID NO: 1495 - protein, 12 aa, Artificial Sequence
  Description of Artificial Sequence: Synthetic peptide
CATWDTSLRGVF

SEQ ID NO: 1496 - protein, 13 aa, Artificial Sequence
  Description of Artificial Sequence: Synthetic peptide
CATWDTSLPAWVF

SEQ ID NO: 1497 - protein, 13 aa, Artificial Sequence
  Description of Artificial Sequence: Synthetic peptide
CATWDTSLNVGVF

SEQ ID NO: 1498 - protein, 13 aa, Artificial Sequence
  Description of Artificial Sequence: Synthetic peptide
CATWDTSLGIVLF

SEQ ID NO: 1499 - protein, 14 aa, Artificial Sequence
  Description of Artificial Sequence: Synthetic peptide
CATWDTSLGARVVF

SEQ ID NO: 1500 - protein, 12 aa, Artificial Sequence
  Description of Artificial Sequence: Synthetic peptide
CATWDTSLGALF

SEQ ID NO: 1501 - protein, 13 aa, Artificial Sequence
  Description of Artificial Sequence: Synthetic peptide
CATWDTSLATGLF

SEQ ID NO: 1502 - protein, 13 aa, Artificial Sequence
  Description of Artificial Sequence: Synthetic peptide
CATWDTSLAAWVF

SEQ ID NO: 1503 - protein, 13 aa, Artificial Sequence
  Description of Artificial Sequence: Synthetic peptide
CATWDTRLSAVVF

SEQ ID NO: 1504 - protein, 13 aa, Artificial Sequence [sequence omitted]

SEQ ID NO: 1505 - protein, 13 aa, Artificial Sequence
  Description of Artificial Sequence: Synthetic peptide
CATWDTRLLITVF

SEQ ID NO: 1506 - protein, 13 aa, Artificial Sequence
  Description of Artificial Sequence: Synthetic peptide
CATWDTLLSVELF

SEQ ID NO: 1507 - protein, 14 aa, Artificial Sequence
  Description of Artificial Sequence: Synthetic peptide
CATWDTGRNPHVVF

SEQ ID NO: 1508 - protein, 13 aa, Artificial Sequence
  Description of Artificial Sequence: Synthetic peptide
CATWDTGLSSVLF

SEQ ID NO: 1509 - protein, 12 aa, Artificial Sequence
  Description of Artificial Sequence: Synthetic peptide
CATWDTGLSAVF

SEQ ID NO: 1510 - protein, 13 aa, Artificial Sequence
  Description of Artificial Sequence: Synthetic peptide
CATWDRTLSIGVF

SEQ ID NO: 1511 - protein, 13 aa, Artificial Sequence
  Description of Artificial Sequence: Synthetic peptide
CATWDRSVTAVLF

SEQ ID NO: 1512 - protein, 13 aa, Artificial Sequence [sequence omitted]

SEQ ID NO: 1513 - protein, 13 aa, Artificial Sequence [sequence omitted]

SEQ ID NO: 1514 - protein, 15 aa, Artificial Sequence
  Description of Artificial Sequence: Synthetic peptide
CATWDRSLSAVPWVF

SEQ ID NO: 1515 - protein, 13 aa, Artificial Sequence [sequence omitted]

SEQ ID NO: 1516 - protein, 13 aa, Artificial Sequence
  Description of Artificial Sequence: Synthetic peptide
CATWDRSLRAGVF

SEQ ID NO: 1517 - protein, 13 aa, Artificial Sequence
  Description of Artificial Sequence: Synthetic peptide
CATWDRSLNVYVL

SEQ ID NO: 1518 - protein, 13 aa, Artificial Sequence
  Description of Artificial Sequence: Synthetic peptide
CATWDRILSAEVF

SEQ ID NO: 1519 - protein, 13 aa, Artificial Sequence
  Description of Artificial Sequence: Synthetic peptide
CATWDRGLSTGVF

SEQ ID NO: 1520 - protein, 13 aa, Artificial Sequence
  Description of Artificial Sequence: Synthetic peptide
CATWDNYLGAAVF

SEQ ID NO: 1521 - protein, 14 aa, Artificial Sequence
  Description of Artificial Sequence: Synthetic peptide
CATWDNTPSNIVVF

SEQ ID NO: 1522 - protein, 13 aa, Artificial Sequence
  Description of Artificial Sequence: Synthetic peptide
CATWDNTLSVWVF

SEQ ID NO: 1523 - protein, 14 aa, Artificial Sequence
  Description of Artificial Sequence: Synthetic peptide
CATWDNTLSVNWVF

SEQ ID NO: 1524 - protein, 14 aa, Artificial Sequence
  Description of Artificial Sequence: Synthetic peptide
CATWDNTLNVFYVF

SEQ ID NO: 1525 - protein, 13 aa, Artificial Sequence
  Description of Artificial Sequence: Synthetic peptide
CATWDNRLSSVVF

SEQ ID NO: 1526 - protein, 13 aa, Artificial Sequence
  Description of Artificial Sequence: Synthetic peptide
CATWDNRLSAGVL

SEQ ID NO: 1527 - protein, 13 aa, Artificial Sequence
  Description of Artificial Sequence: Synthetic peptide
CATWDNRLSAGVF

SEQ ID NO: 1528 - protein, 11 aa, Artificial Sequence
  Description of Artificial Sequence: Synthetic peptide
CATWDNRDWVF

SEQ ID NO: 1529 - protein, 13 aa, Artificial Sequence
  Description of Artificial Sequence: Synthetic peptide
CATWDNNLGAGVF

SEQ ID NO: 1530 - protein, 13 aa, Artificial Sequence
  Description of Artificial Sequence: Synthetic peptide
CATWDNKLTSGVF

SEQ ID NO: 1531 - protein, 13 aa, Artificial Sequence
  Description of Artificial Sequence: Synthetic peptide
CATWDNILSAWVF

SEQ ID NO: 1532 - protein, 13 aa, Artificial Sequence
  Description of Artificial Sequence: Synthetic peptide
CATWDNDIHSGLF

SEQ ID NO: 1533 - protein, 12 aa, Artificial Sequence
  Description of Artificial Sequence: Synthetic peptide
CATWDLSLSALF

SEQ ID NO: 1534 - protein, 13 aa, Artificial Sequence
  Description of Artificial Sequence: Synthetic peptide
CATWDITLSAEVF

SEQ ID NO: 1535 - protein, 14 aa, Artificial Sequence
  Description of Artificial Sequence: Synthetic peptide
CATWDISPSAGGVF

SEQ ID NO: 1536 - protein, 15 aa, Artificial Sequence
  Description of Artificial Sequence: Synthetic peptide
CATWDISLSTGRAVF

SEQ ID NO: 1537 - protein, 12 aa, Artificial Sequence
  Description of Artificial Sequence: Synthetic peptide
CATWDISLSQVF

SEQ ID NO: 1538 - protein, 13 aa, Artificial Sequence
  Description of Artificial Sequence: Synthetic peptide
CATWDIRLSSGVF

SEQ ID NO: 1539 - protein, 14 aa, Artificial Sequence
  Description of Artificial Sequence: Synthetic peptide
CATWDIGPSAGGVF

SEQ ID NO: 1540 - protein, 13 aa, Artificial Sequence
  Description of Artificial Sequence: Synthetic peptide
CATWDHSRAGVLF

SEQ ID NO: 1541 - protein, 14 aa, Artificial Sequence
  Description of Artificial Sequence: Synthetic peptide
CATWDHSPSVGEVF

SEQ ID NO: 1542 - protein, 13 aa, Artificial Sequence
  Description of Artificial Sequence: Synthetic peptide
CATWDHSLRVGVF

SEQ ID NO: 1543 - protein, 13 aa, Artificial Sequence
  Description of Artificial Sequence: Synthetic peptide
CATWDHSLNIGVF

SEQ ID NO: 1544 - protein, 13 aa, Artificial Sequence
  Description of Artificial Sequence: Synthetic peptide
CATWDHSLGLWAF

SEQ ID NO: 1545 - protein, 12 aa, Artificial Sequence
  Description of Artificial Sequence: Synthetic peptide
CATWDHNLRLVF

SEQ ID NO: 1546 - protein, 13 aa, Artificial Sequence
  Description of Artificial Sequence: Synthetic peptide
CATWDHILASGVF

SEQ ID NO: 1547 - protein, 13 aa, Artificial Sequence
  Description of Artificial Sequence: Synthetic peptide
CATWDFSLSVWVF

SEQ ID NO: 1548 - protein, 13 aa, Artificial Sequence
  Description of Artificial Sequence: Synthetic peptide
CATWDFSLSAWVF

SEQ ID NO: 1549 - protein, 13 aa, Artificial Sequence
  Description of Artificial Sequence: Synthetic peptide
CATWDDTLTAGVF

SEQ ID NO: 1550 - protein, 13 aa, Artificial Sequence
  Description of Artificial Sequence: Synthetic peptide
CATWDDRLSAVLF

SEQ ID NO: 1551 - protein, 13 aa, Artificial Sequence
  Description of Artificial Sequence: Synthetic peptide
CATWDDRLDAAVF

SEQ ID NO: 1552 - protein, 13 aa, Artificial Sequence
  Description of Artificial Sequence: Synthetic peptide
CATWDATLNTGVF

SEQ ID NO: 1553 - protein, 13 aa, Artificial Sequence
  Description of Artificial Sequence: Synthetic peptide
CATWDASLSVWLL

SEQ ID NO: 1554 - protein, 13 aa, Artificial Sequence [sequence omitted]

SEQ ID NO: 1555 - protein, 13 aa, Artificial Sequence
  Description of Artificial Sequence: Synthetic peptide
CATRDTTLSAVLF

SEQ ID NO: 1556 - protein, 13 aa, Artificial Sequence
  Description of Artificial Sequence: Synthetic peptide
CATLGSSLSLWVF

SEQ ID NO: 1557 - protein, 13 aa, Artificial Sequence
  Description of Artificial Sequence: Synthetic peptide
CATIETSLPAWVF

SEQ ID NO: 1558 - protein, 13 aa, Artificial Sequence
  Description of Artificial Sequence: Synthetic peptide
CATGDRSLTVEVF

SEQ ID NO: 1559 - protein, 12 aa, Artificial Sequence
  Description of Artificial Sequence: Synthetic peptide
CATGDLGLTIVF

SEQ ID NO: 1560 - protein, 14 aa, Artificial Sequence
  Description of Artificial Sequence: Synthetic peptide
CASWDYRGRSGWVF

SEQ ID NO: 1561 - protein, 13 aa, Artificial Sequence
  Description of Artificial Sequence: Synthetic peptide
CASWDTTLNVGVF

SEQ ID NO: 1562 - protein, 13 aa, Artificial Sequence
  Description of Artificial Sequence: Synthetic peptide
CASWDTTLGFVLF

SEQ ID NO: 1563 - protein, 14 aa, Artificial Sequence
  Description of Artificial Sequence: Synthetic peptide
CASWDTSLSGGYVF

SEQ ID NO: 1564 - protein, 13 aa, Artificial Sequence
  Description of Artificial Sequence: Synthetic peptide
CASWDTSLRAGVF

SEQ ID NO: 1565 - protein, 13 aa, Artificial Sequence
  Description of Artificial Sequence: Synthetic peptide
CASWDTSLGAGVF

SEQ ID NO: 1566 - protein, 13 aa, Artificial Sequence
  Description of Artificial Sequence: Synthetic peptide
CASWDRGLSAVVF

SEQ ID NO: 1567 - protein, 13 aa, Artificial Sequence
  Description of Artificial Sequence: Synthetic peptide
CASWDNVLRGVVF

SEQ ID NO: 1568 - protein, 13 aa, Artificial Sequence
  Description of Artificial Sequence: Synthetic peptide
CASWDNRLTAVVF

SEQ ID NO: 1569 - protein, 12 aa, Artificial Sequence
  Description of Artificial Sequence: Synthetic peptide
CASWDASLSVAF

SEQ ID NO: 1570 - protein, 13 aa, Artificial Sequence
  Description of Artificial Sequence: Synthetic peptide
CASWDAGLSSYVF

SEQ ID NO: 1571 - protein, 13 aa, Artificial Sequence
  Description of Artificial Sequence: Synthetic peptide
CASGDTSLSGVIF

SEQ ID NO: 1572 - protein, 13 aa, Artificial Sequence
  Description of Artificial Sequence: Synthetic peptide
CARWHTSLSIWVF

SEQ ID NO: 1573 - protein, 15 aa, Artificial Sequence
  Description of Artificial Sequence: Synthetic peptide
CAIWDTGLSPGQVAF

SEQ ID NO: 1574 - protein, 13 aa, Artificial Sequence
  Description of Artificial Sequence: Synthetic peptide
CAAWHSGLGLPVF

SEQ ID NO: 1575 - protein, 13 aa, Artificial Sequence
  Description of Artificial Sequence: Synthetic peptide
CAAWDYSLSAGVF

SEQ ID NO: 1576 - protein, 13 aa, Artificial Sequence
  Description of Artificial Sequence: Synthetic peptide
CAAWDTTLRVRLF

SEQ ID NO: 1577 - protein, 13 aa, Artificial Sequence
  Description of Artificial Sequence: Synthetic peptide
CAAWDTSLTAWVF

SEQ ID NO: 1578 - protein, 13 aa, Artificial Sequence
  Description of Artificial Sequence: Synthetic peptide
CAAWDTSLSGGVF

SEQ ID NO: 1579 - protein, 14 aa, Artificial Sequence
  Description of Artificial Sequence: Synthetic peptide
CAAWDTSLSGEAVF

SEQ ID NO: 1580 - protein, 13 aa, Artificial Sequence
  Description of Artificial Sequence: Synthetic peptide
CAAWDTSLSGAVF

SEQ ID NO: 1581 - protein, 13 aa, Artificial Sequence
  Description of Artificial Sequence: Synthetic peptide
CAAWDTSLSAWVF

SEQ ID NO: 1582 - protein, 13 aa, Artificial Sequence
  Description of Artificial Sequence: Synthetic peptide
CAAWDTSLSAGVF

SEQ ID NO: 1583 - protein, 13 aa, Artificial Sequence
  Description of Artificial Sequence: Synthetic peptide
CAAWDTSLDTYVF

SEQ ID NO: 1584 - protein, 13 aa, Artificial Sequence
  Description of Artificial Sequence: Synthetic peptide
CAAWDTRLSGVLF

SEQ ID NO: 1585 - protein, 13 aa, Artificial Sequence
  Description of Artificial Sequence: Synthetic peptide
CAAWDTRLSAGVF

SEQ ID NO: 1586 - protein, 13 aa, Artificial Sequence
  Description of Artificial Sequence: Synthetic peptide
CAAWDRSLSTGVF

SEQ ID NO: 1587 - protein, 12 aa, Artificial Sequence
  Description of Artificial Sequence: Synthetic peptide
CAAWDIRRSVLF

SEQ ID NO: 1588 - protein, 12 aa, Artificial Sequence
  Description of Artificial Sequence: Synthetic peptide
CAAWDHTQRLSF

SEQ ID NO: 1589 - protein, 14 aa, Artificial Sequence
  Description of Artificial Sequence: Synthetic peptide
CAAWDHSLSAGQVF

SEQ ID NO: 1590 - protein, 13 aa, Artificial Sequence
  Description of Artificial Sequence: Synthetic peptide
CAAVDTGLKEWVF

SEQ ID NO: 1591 - DNA, 39 bp, Artificial Sequence
  Description of Artificial Sequence: Synthetic oligonucleotide
tgcggaacatgggataccagcctgagtgctgtggtgttc

SEQ ID NO: 1592 - DNA, 39 bp, Artificial Sequence
  Description of Artificial Sequence: Synthetic oligonucleotide
tgcggaacatgggataccagcctgagtgctggggtgttc

SEQ ID NO: 1593 - DNA, 39 bp, Artificial Sequence
  Description of Artificial Sequence: Synthetic oligonucleotide
tgcggaacatgggataccagcctgagtgcttgggtgttc

SEQ ID NO: 1594 - DNA, 39 bp, Artificial Sequence
  Description of Artificial Sequence: Synthetic oligonucleotide
tgcggaacatgggataggagcctgagtgcgggggtgttc

SEQ ID NO: 1595 - DNA, 39 bp, Artificial Sequence
  Description of Artificial Sequence: Synthetic oligonucleotide
tgcggaacatgggataggagcctgagtgcttgggtattt

SEQ ID NO: 1596 - DNA, 39 bp, Artificial Sequence
  Description of Artificial Sequence: Synthetic oligonucleotide
tgcggaacatgggataccagcctgagtggtggggtgttc

SEQ ID NO: 1597 - DNA, 39 bp, Artificial Sequence
  Description of Artificial Sequence: Synthetic oligonucleotide
tgcggaacatgggatactagcctgcgtgctggcgtcttc

SEQ ID NO: 1598 - DNA, 39 bp, Artificial Sequence
  Description of Artificial Sequence: Synthetic oligonucleotide
tgcggaacatgggataggagcctgagtgtttgggtgttc

SEQ ID NO: 1599 - DNA, 39 bp, Artificial Sequence
  Description of Artificial Sequence: Synthetic oligonucleotide
tgcggaacatgggataccagtctgagtgttgtggtcttc

SEQ ID NO: 1600 - DNA, 39 bp, Artificial Sequence
  Description of Artificial Sequence: Synthetic oligonucleotide
tgcggaacgtgggataccagcctgagtgctgcggtgttc

SEQ ID NO: 1601 - DNA, 39 bp, Artificial Sequence
  Description of Artificial Sequence: Synthetic oligonucleotide
tgcggagcatgggataccagcctgagtgctggagtgttc

SEQ ID NO: 1602 - DNA, 39 bp, Artificial Sequence
  Description of Artificial Sequence: Synthetic oligonucleotide
tgcgcaacatgggataccagcctgagtgctgtggtattc

SEQ ID NO: 1603 - DNA, 39 bp, Artificial Sequence
  Description of Artificial Sequence: Synthetic oligonucleotide
tgcgcaacatgggataccagcctgagtgctggtgtgttc

SEQ ID NO: 1604 - DNA, 39 bp, Artificial Sequence
  Description of Artificial Sequence: Synthetic oligonucleotide
tgtggaacatgggagagcagcctgagtgcttgggtgttc

SEQ ID NO: 1605 - DNA, 39 bp, Artificial Sequence
  Description of Artificial Sequence: Synthetic oligonucleotide
tgcggaacatgggataccaccctgagtgcgggtgtcttc

SEQ ID NO: 1606 - DNA, 39 bp, Artificial Sequence
  Description of Artificial Sequence: Synthetic oligonucleotide
tgcggaacatgggatactagcctgagtgtgtgggtgttc

SEQ ID NO: 1607 - DNA, 39 bp, Artificial Sequence
  Description of Artificial Sequence: Synthetic oligonucleotide
tgcggaacatgggatactagcctgagtgttggggtgttc

SEQ ID NO: 1608 - DNA, 39 bp, Artificial Sequence
  Description of Artificial Sequence: Synthetic oligonucleotide
tgcggaacatgggacaccagtctgagcactggcgtcttc

SEQ ID NO: 1609 - DNA, 39 bp, Artificial Sequence
  Description of Artificial Sequence: Synthetic oligonucleotide
tgcggaacatgggataccagcctgagtggtgtggtcttc

SEQ ID NO: 1610 - DNA, 39 bp, Artificial Sequence
  Description of Artificial Sequence: Synthetic oligonucleotide
tgcggaacatgggataccagcctgagtgcttatgtcttc

SEQ ID NO: 1611 - DNA, 39 bp, Artificial Sequence
  Description of Artificial Sequence: Synthetic oligonucleotide
tgcggaacatgggataccagcctgagtgctgaggtgttc

SEQ ID NO: 1612 - DNA, 39 bp, Artificial Sequence
  Description of Artificial Sequence: Synthetic oligonucleotide
tgcggaacatgggataccggcctgagtgctggggtattc

SEQ ID NO: 1613 - DNA, 39 bp, Artificial Sequence
  Description of Artificial Sequence: Synthetic oligonucleotide
tgcggaacgtgggataggagcctgagtgcttatgtcttc

SEQ ID NO: 1614 - DNA, 39 bp, Artificial Sequence
  Description of Artificial Sequence: Synthetic oligonucleotide
tgcggaacatgggataggagcctcagtgccgtggtattc

SEQ ID NO: 1615 - DNA, 39 bp, Artificial Sequence
  Description of Artificial Sequence: Synthetic oligonucleotide
tgcggaacatgggataacaccctgagtgcgtgggtgttc

SEQ ID NO: 1616 - DNA, 39 bp, Artificial Sequence
  Description of Artificial Sequence: Synthetic oligonucleotide
tgcggaacatgggataacaggctgagtgctggggtgttc

SEQ ID NO: 1617 - DNA, 39 bp, Artificial Sequence
  Description of Artificial Sequence: Synthetic oligonucleotide
tgcggaacatgggacatcagcctgagtgcttgggtgttc

SEQ ID NO: 1618 - DNA, 39 bp, Artificial Sequence
  Description of Artificial Sequence: Synthetic oligonucleotide
tgcggaacatggcatagcagcctgagtgctggggtattc

SEQ ID NO: 1619 - DNA, 39 bp, Artificial Sequence
  Description of Artificial Sequence: Synthetic oligonucleotide
tgcggaacatggggtagcagtttgagtgcttgggtgttc

SEQ ID NO: 1620 - DNA, 39 bp, Artificial Sequence
  Description of Artificial Sequence: Synthetic oligonucleotide
tgcggaacatgggagagcagcctgagtggttgggtgttc

SEQ ID NO: 1621 - DNA, 39 bp, Artificial Sequence
  Description of Artificial Sequence: Synthetic oligonucleotide
tgcggaacatgggagagcagcctgagtgctgtggttttc

SEQ ID NO: 1622 - DNA, 39 bp, Artificial Sequence
  Description of Artificial Sequence: Synthetic oligonucleotide
tgcggaacatgggattacagcctgagtgctgtggtattc

SEQ ID NO: 1623 - DNA, 39 bp, Artificial Sequence
  Description of Artificial Sequence: Synthetic oligonucleotide
tgcggaacatgggattacagcctgagtgctggggtattc

SEQ ID NO: 1624 - DNA, 39 bp, Artificial Sequence
  Description of Artificial Sequence: Synthetic oligonucleotide
tgcggaacatgggatgtcagcctgagtgttggagtgttc

SEQ ID NO: 1625 - DNA, 39 bp, Artificial Sequence
  Description of Artificial Sequence: Synthetic oligonucleotide
tgcggaacatgggataccaccctgagtgctgtggttttc

SEQ ID NO: 1626 - DNA, 39 bp, Artificial Sequence
  Description of Artificial Sequence: Synthetic oligonucleotide
tgcggaacatgggataccactctgaatattggggtgttc

SEQ ID NO: 1627 - DNA, 39 bp, Artificial Sequence
  Description of Artificial Sequence: Synthetic oligonucleotide
tgcggaacatgggataccagcctgactgctgtggtattc

SEQ ID NO: 1628 - DNA, 39 bp, Artificial Sequence
  Description of Artificial Sequence: Synthetic oligonucleotide
tgcggaacctgggataccagcctgactgctgctgtgttc

SEQ ID NO: 1629 - DNA, 39 bp, Artificial Sequence
  Description of Artificial Sequence: Synthetic oligonucleotide
tgcggcacatgggataccagcctgagtgtggggctattc

SEQ ID NO: 1630 - DNA, 39 bp, Artificial Sequence
  Description of Artificial Sequence: Synthetic oligonucleotide
tgcggaacctgggataccagcctgagtggtagggtgttc

SEQ ID NO: 1631 - DNA, 39 bp, Artificial Sequence
  Description of Artificial Sequence: Synthetic oligonucleotide
tgcggaacatgggataccagcctgagtggtgcagtgttc

SEQ ID NO: 1632 - DNA, 39 bp, Artificial Sequence
  Description of Artificial Sequence: Synthetic oligonucleotide
tgcggaacatgggataccagcctgagtgctggcctgttc

SEQ ID NO: 1633 - DNA, 42 bp, Artificial Sequence
  Description of Artificial Sequence: Synthetic oligonucleotide
tgcggaacatgggataccagcctgagtgctggaggggtcttc

SEQ ID NO: 1634 - DNA, 39 bp, Artificial Sequence
  Description of Artificial Sequence: Synthetic oligonucleotide
tgcggaacatgggataccagcctgcgtgcttatgtcttc

SEQ ID NO: 1635 - DNA, 39 bp, Artificial Sequence
  Description of Artificial Sequence: Synthetic oligonucleotide
tgcggaacatgggatactagtttgcgtgcttgggtattc

SEQ ID NO: 1636 - DNA, 39 bp, Artificial Sequence
  Description of Artificial Sequence: Synthetic oligonucleotide
tgcggaacatgggataccagcctgaatactggggtattc

SEQ ID NO: 1637 - DNA, 39 bp, Artificial Sequence
  Description of Artificial Sequence: Synthetic oligonucleotide
tgcggaacatgggataccagcctgaatatttgggtgttc

SEQ ID NO: 1638 - DNA, 39 bp, Artificial Sequence
  Description of Artificial Sequence: Synthetic oligonucleotide
tgcggaacatgggatacaagcctgaatattggggtgttc

SEQ ID NO: 1639 - DNA, 39 bp, Artificial Sequence
  Description of Artificial Sequence: Synthetic oligonucleotide
tgcggaacatgggataccagcctgattgctgtggtgttc

SEQ ID NO: 1640 - DNA, 39 bp, Artificial Sequence
  Description of Artificial Sequence: Synthetic oligonucleotide
tgcggaacgtgggataggagcctgagtggttgggtgttc

SEQ ID NO: 1641 - DNA, 39 bp, Artificial Sequence
  Description of Artificial Sequence: Synthetic oligonucleotide
tgcggaacatgggataacaggctgagtggttgggtgttc

SEQ ID NO: 1642 - DNA, 39 bp, Artificial Sequence
  Description of Artificial Sequence: Synthetic oligonucleotide
tgcggaacgtgggataagagcctgagtgctgtggtcttc

SEQ ID NO: 1643 - DNA, 39 bp, Artificial Sequence
  Description of Artificial Sequence: Synthetic oligonucleotide
tgcggaacatgggataaaggcctgagtgcttgggtgttc

SEQ ID NO: 1644 - DNA, 39 bp, Artificial Sequence
  Description of Artificial Sequence: Synthetic oligonucleotide
tgcggaacatgggatatcagcctgagtgctggggtgttc

SEQ ID NO: 1645 - DNA, 45 bp, Artificial Sequence
  Description of Artificial Sequence: Synthetic oligonucleotide
tgcggaacatgggatgagagcctgagtggtggcgaggtggtcttc

SEQ ID NO: 1646 - DNA, 39 bp, Artificial Sequence
  Description of Artificial Sequence: Synthetic oligonucleotide
tgcggaacatgggatgccagcctgagtgcctgggtgttc

SEQ ID NO: 1647 - DNA, 39 bp, Artificial Sequence
  Description of Artificial Sequence: Synthetic oligonucleotide
tgcggaacttgggatgccggcctgagtgcttgggtgttc

SEQ ID NO: 1648 - DNA, 39 bp, Artificial Sequence
  Description of Artificial Sequence: Synthetic oligonucleotide
tgcggagcatgggataccagcctgagtgcttgggtgttc

SEQ ID NO: 1649 - DNA, 39 bp, Artificial Sequence
  Description of Artificial Sequence: Synthetic oligonucleotide
tgcggagcatgggataccagcctgagtgctgtggtgttc

SEQ ID NO: 1650 - DNA, 39 bp, Artificial Sequence
  Description of Artificial Sequence: Synthetic oligonucleotide
tgcggagcatgggataccagcctgcgtgctggggttttc

SEQ ID NO: 1651 - DNA, 39 bp, Artificial Sequence
  Description of Artificial Sequence: Synthetic oligonucleotide
tgcgcaacatgggataccagcgtgagtgcttgggtgttc

SEQ ID NO: 1652 - DNA, 39 bp, Artificial Sequence
  Description of Artificial Sequence: Synthetic oligonucleotide
tgcgcaacatgggataccagcctgagtgcgtgggtgttc

SEQ ID NO: 1653 - DNA, 39 bp, Artificial Sequence
  Description of Artificial Sequence: Synthetic oligonucleotide
tgcgcaacatgggacaacaccctgagtgctggggtgttc

SEQ ID NO: 1654 - DNA, 39 bp, Artificial Sequence
  Description of Artificial Sequence: Synthetic oligonucleotide
tgcgcagcatgggataggagcctgagtgtttgggtgttc

SEQ ID NO: 1655 - DNA, 39 bp, Artificial Sequence
  Description of Artificial Sequence: Synthetic oligonucleotide
tgctacacatggcattccagtctgcgtggtggggtgttc

SEQ ID NO: 1656 - DNA, 39 bp, Artificial Sequence
  Description of Artificial Sequence: Synthetic oligonucleotide
tgcgtaacgtggactagtagcccgagtgcttgggtgttc

SEQ ID NO: 1657 - DNA, 33 bp, Artificial Sequence
  Description of Artificial Sequence: Synthetic oligonucleotide
tgcgtgacatggcgtggtggccttgtgttgttc

SEQ ID NO: 1658 - DNA, 39 bp, Artificial Sequence
  Description of Artificial Sequence: Synthetic oligonucleotide
tgcgtaacatgggataccagcctgacttctgtggtactc

SEQ ID NO: 1659 - DNA, 42 bp, Artificial Sequence
  Description of Artificial Sequence: Synthetic oligonucleotide
tgcgtaacatgggataccagcctgagtgtttattgggtgttc

SEQ ID NO: 1660 - DNA, 39 bp, Artificial Sequence
  Description of Artificial Sequence: Synthetic oligonucleotide
tgcgttacatgggataccagcctgagtgcctgggtgttc

SEQ ID NO: 1661 - DNA, 39 bp, Artificial Sequence
  Description of Artificial Sequence: Synthetic oligonucleotide
tgcgtcacatgggataccgacctcagcgttgcgctcttc

SEQ ID NO: 1662 - DNA, 39 bp, Artificial Sequence
  Description of Artificial Sequence: Synthetic oligonucleotide
tgcgtaacatgggataggagcctgagtggttgggtgttc

SEQ ID NO: 1663 - DNA, 39 bp, Artificial Sequence
  Description of Artificial Sequence: Synthetic oligonucleotide
tgcgtaacatgggatcgcagcctgagagaggtgttattc

SEQ ID NO: 1664 - DNA, 39 bp, Artificial Sequence
  Description of Artificial Sequence: Synthetic oligonucleotide
tgcgtaacatgggatcgcagcctgagagcggtggtattc

SEQ ID NO: 1665 - DNA, 39 bp, Artificial Sequence
  Description of Artificial Sequence: Synthetic oligonucleotide
tgcgtaacatgggacaggagcctcgatgctggggttttc

SEQ ID NO: 1666 - DNA, 39 bp, Artificial Sequence
  Description of Artificial Sequence: Synthetic oligonucleotide
tgcgtgacatgggataacaccctgagtgctggggtcttc

SEQ ID NO: 1667 - DNA, 39 bp, Artificial Sequence
  Description of Artificial Sequence: Synthetic oligonucleotide
tgcgtaacatgggataacaacctgtttggtgtggtcttc

SEQ ID NO: 1668 - DNA, 39 bp, Artificial Sequence
  Description of Artificial Sequence: Synthetic oligonucleotide
tgcgtatcatgggataccagcctgagtggtgcggtattc

SEQ ID NO: 1669 - DNA, 39 bp, Artificial Sequence
  Description of Artificial Sequence: Synthetic oligonucleotide
tgcgtctcatgggataccagcctgagtgctggggtattc

SEQ ID NO: 1670 - DNA, 39 bp, Artificial Sequence
  Description of Artificial Sequence: Synthetic oligonucleotide
tgcacaacatggtttaggactccgagtgatgtggtcttc

SEQ ID NO: 1671 - DNA, 39 bp, Artificial Sequence
  Description of Artificial Sequence: Synthetic oligonucleotide
tgcacaacatggtttaggactgcgagtgatgtggtcttc

SEQ ID NO: 1672 - DNA, 36 bp, Artificial Sequence
  Description of Artificial Sequence: Synthetic oligonucleotide
tgcacaacgtgggattacggtctgagtgtcgtcttc

SEQ ID NO: 1673 - DNA, 42 bp, Artificial Sequence
  Description of Artificial Sequence: Synthetic oligonucleotide
tgcacagcaagggataccagcctgagtcctggcggggtcttc

SEQ ID NO: 1674 - DNA, 39 bp, Artificial Sequence
  Description of Artificial Sequence: Synthetic oligonucleotide
tgctcaacatggaatacgaggccgagtgatgtggtgttc

SEQ ID NO: 1675 - DNA, 39 bp, Artificial Sequence
  Description of Artificial Sequence: Synthetic oligonucleotide
tgttcaacatgggagagcagtttgactactgtggtcttc

SEQ ID NO: 1676 - DNA, 39 bp, Artificial Sequence
  Description of Artificial Sequence: Synthetic oligonucleotide
tgctcaacatgggataccagcctcactaatgtgctattc

SEQ ID NO: 1677 - DNA, 39 bp, Artificial Sequence
  Description of Artificial Sequence: Synthetic oligonucleotide
tgctcaacatgggataccagcctgagtggagtagtcttc

SEQ ID NO: 1678 - DNA, 39 bp, Artificial Sequence
  Description of Artificial Sequence: Synthetic oligonucleotide
tgctcaacatgggatcacagcctgaaagctgcactgttc

SEQ ID NO: 1679 - DNA, 39 bp, Artificial Sequence
  Description of Artificial Sequence: Synthetic oligonucleotide
tgctcaacctgggatgcgaggctgagtgtccgggtgttc

SEQ ID NO: 1680 - DNA, 36 bp, Artificial Sequence
  Description of Artificial Sequence: Synthetic oligonucleotide
tgctcctcatatacaagcagcagcacttgggtgttc

SEQ ID NO: 1681 - DNA, 39 bp, Artificial Sequence
  Description of Artificial Sequence: Synthetic oligonucleotide
tgcagctcatacgcaacccgcggccttcgtgtgttgttc

SEQ ID NO: 1682 - DNA, 39 bp, Artificial Sequence
  Description of Artificial Sequence: Synthetic oligonucleotide
tgttcatcatgggacgccaccctgagtgttcgcatattc

SEQ ID NO: 1683 - DNA, 39 bp, Artificial Sequence
  Description of Artificial Sequence: Synthetic oligonucleotide
tgtcaggtgtgggagggtagtagtgatcattgggtgttc

SEQ ID NO: 1684 - DNA, 39 bp, Artificial Sequence
  Description of Artificial Sequence: Synthetic oligonucleotide
tgccaaacctgggataacagactgagtgctgtggtgttc

SEQ ID NO: 1685 - DNA, 39 bp, Artificial Sequence
  Description of Artificial Sequence: Synthetic oligonucleotide
tgtcaaacgtgggatcacagcctgcatgttggggtgttc

SEQ ID NO: 1686 - DNA, 39 bp, Artificial Sequence
  Description of Artificial Sequence: Synthetic oligonucleotide
tgccagtcctatgacgacatcttgaatgtttgggtcctt

SEQ ID NO: 1687 - DNA, 39 bp, Artificial Sequence
  Description of Artificial Sequence: Synthetic oligonucleotide
tgcaatacatgggataagagtttgacttctgaactcttc

SEQ ID NO: 1688 - DNA, 39 bp, Artificial Sequence
  Description of Artificial Sequence: Synthetic oligonucleotide
tgcttaacatgggatcgcagcctgaatgtgagggtgttc

SEQ ID NO: 1689 - DNA, 39 bp, Artificial Sequence
  Description of Artificial Sequence: Synthetic oligonucleotide
tgcctaacatgggaccacagcctgactgcttatgtcttc

SEQ ID NO: 1690 - DNA, 39 bp, Artificial Sequence
  Description of Artificial Sequence: Synthetic oligonucleotide
tgcttaacaagggataccagtctgagtgcccctgtgttc

SEQ ID NO: 1691 - DNA, 42 bp, Artificial Sequence
  Description of Artificial Sequence: Synthetic oligonucleotide
tgcaaaacatgggaaagtggccttaattttggccacgtcttc

SEQ ID NO: 1692 - DNA, 39 bp, Artificial Sequence
  Description of Artificial Sequence: Synthetic oligonucleotide
tgcaaaacatgggataccagcctgagtgctgtggtcttc

SEQ ID NO: 1693 - DNA, 39 bp, Artificial Sequence
  Description of Artificial Sequence: Synthetic oligonucleotide
tgcggagtctgggatgtcagtctgggtgctggggtgttc

SEQ ID NO: 1694 - DNA, 39 bp, Artificial Sequence
  Description of Artificial Sequence: Synthetic oligonucleotide
tgcggagtctgggataccaccccgagtgccgttcttttc

SEQ ID NO: 1695 - DNA, 39 bp, Artificial Sequence
  Description of Artificial Sequence: Synthetic oligonucleotide
tgcggagtctgggataccaccctgagtgccgttcttttc

SEQ ID NO: 1696 - DNA, 33 bp, Artificial Sequence
  Description of Artificial Sequence: Synthetic oligonucleotide
tgcggagtatgggataccagcctgggggtcttc

SEQ ID NO: 1697 - DNA, 39 bp, Artificial Sequence
  Description of Artificial Sequence: Synthetic oligonucleotide
tgcggggtatgggataccaacctgggtaaatgggttttc

SEQ ID NO: 1698 - DNA, 42 bp, Artificial Sequence
  Description of Artificial Sequence: Synthetic oligonucleotide
tgtggagtttgggatactggcctggatgctggttgggtgttc

SEQ ID NO: 1699 - DNA, 39 bp, Artificial Sequence
  Description of Artificial Sequence: Synthetic oligonucleotide
tgcggagtgtgggataacgtcctggaggcctatgtcttc

SEQ ID NO: 1700 - DNA, 42 bp, Artificial Sequence
  Description of Artificial Sequence: Synthetic oligonucleotide
tgcggagtctgggatatcagcctgagtgctaattgggtgttc

SEQ ID NO: 1701 - DNA, 39 bp, Artificial Sequence
  Description of Artificial Sequence: Synthetic oligonucleotide
tgcggagtatgggatcacagcctggggatttgggccttc

SEQ ID NO: 1702 - DNA, 39 bp, Artificial Sequence
  Description of Artificial Sequence: Synthetic oligonucleotide
tgcggagtttgggatgatattctgactgctgaagtgttc

SEQ ID NO: 1703 - DNA, 33 bp, Artificial Sequence
  Description of Artificial Sequence: Synthetic oligonucleotide
tgcggagttcgggataccagcctgggggtcttc

SEQ ID NO: 1704 - DNA, 39 bp, Artificial Sequence
  Description of Artificial Sequence: Synthetic oligonucleotide
tgcggaacatacgatacgagcctgcctgcttgggtgttt

SEQ ID NO: 1705 - DNA, 39 bp, Artificial Sequence
  Description of Artificial Sequence: Synthetic oligonucleotide
tgcggaacttacgataatcttgtatttggttatgtcttc

SEQ ID NO: 1706 - DNA, 36 bp, Artificial Sequence
  Description of Artificial Sequence: Synthetic oligonucleotide
tgcggaacatacgatgatagactcagagaggtgttc

SEQ ID NO: 1707 - DNA, 39 bp, Artificial Sequence
  Description of Artificial Sequence: Synthetic oligonucleotide
tgcggaacgtgggttaccagcctgagtgctggggtgttc

SEQ ID NO: 1708 - DNA, 39 bp, Artificial Sequence
  Description of Artificial Sequence: Synthetic oligonucleotide
tgcggaacatgggttagcagcctgactactgtagtattc

SEQ ID NO: 1709 - DNA, 39 bp, Artificial Sequence
  Description of Artificial Sequence: Synthetic oligonucleotide
tgcggaacatgggttagcagcctgaacgtctgggtgttc

SEQ ID NO: 1710 - DNA, 33 bp, Artificial Sequence
  Description of Artificial Sequence: Synthetic oligonucleotide
tgcggaacatgggttggcaggttttgggtattc

SEQ ID NO: 1711 - DNA, 42 bp, Artificial Sequence
  Description of Artificial Sequence: Synthetic oligonucleotide
tgcggaacatggtctggcggcccgagtggccattggttgttc

SEQ ID NO: 1712 - DNA, 42 bp, Artificial Sequence
  Description of Artificial Sequence: Synthetic oligonucleotide
tgcggaacatggtctggcggcctgagtggccattggttgttc

SEQ ID NO: 1713 - DNA, 39 bp, Artificial Sequence
  Description of Artificial Sequence: Synthetic oligonucleotide
tgcggaacgtggcagaccggccgggaggctgtcctattt

SEQ ID NO: 1714 - DNA, 36 bp, Artificial Sequence
  Description of Artificial Sequence: Synthetic oligonucleotide
tgcggaacgtggcagagcaggctgaggtgggtgttc

SEQ ID NO: 1715 - DNA, 36 bp, Artificial Sequence
  Description of Artificial Sequence: Synthetic oligonucleotide
tgcggaacgtggcagagcaggctggggtgggtgttc

SEQ ID NO: 1716 - DNA, 42 bp, Artificial Sequence
  Description of Artificial Sequence: Synthetic oligonucleotide
tgcggaacatggcctaggagcctgagtgctgtttgggtgttc

SEQ ID NO: 1717 - DNA, 45 bp, Artificial Sequence
  Description of Artificial Sequence: Synthetic oligonucleotide
tgcggaacatggaataactacctgagtgctggcgatgtggttttc

SEQ ID NO: 1718 - DNA, 42 bp, Artificial Sequence
  Description of Artificial Sequence: Synthetic oligonucleotide
tgcggaacatggcttggcagccagagtccttattgggtcttc

SEQ ID NO: 1719 - DNA, 39 bp, Artificial Sequence
  Description of Artificial Sequence: Synthetic oligonucleotide
tgcggaacatggcataccggcctgagtgcttatgtcttc

SEQ ID NO: 1720 - DNA, 45 bp, Artificial Sequence
  Description of Artificial Sequence: Synthetic oligonucleotide
tgcggaacatggcatagtaccctgagtgctggccattgggtgttc

SEQ ID NO: 1721 - DNA, 39 bp, Artificial Sequence
  Description of Artificial Sequence: Synthetic oligonucleotide
tgcggaacatggcatagtagcctgagtacttgggtgttc

SEQ ID NO: 1722 - DNA, 39 bp, Artificial Sequence
  Description of Artificial Sequence: Synthetic oligonucleotide
tgcggaacatggcatagcagcctgagtgcctatgtcttc

SEQ ID NO: 1723 - DNA, 39 bp, Artificial Sequence
  Description of Artificial Sequence: Synthetic oligonucleotide
tgcggaacatggcatagcagcctgagtgctgtggtattc

SEQ ID NO: 1724 - DNA, 39 bp, Artificial Sequence
  Description of Artificial Sequence: Synthetic oligonucleotide
tgcggaacgtggcattccggcctgagtgggtgggttttc

SEQ ID NO: 1725 - DNA, 39 bp, Artificial Sequence
  Description of Artificial Sequence: Synthetic oligonucleotide
tgcggaacatggcataacaccctgcgtaatgtgatattc

SEQ ID NO: 1726 - DNA, 36 bp, Artificial Sequence
  Description of Artificial Sequence: Synthetic oligonucleotide
tgcggaacatggcatgccagcctgactgctgtgttc

SEQ ID NO: 1727 - DNA, 45 bp, Artificial Sequence
  Description of Artificial Sequence: Synthetic oligonucleotide
tgcgggacatggggatggtatggcagccagagaggcgtcgtcttc

SEQ ID NO: 1728 - DNA, 45 bp, Artificial Sequence
  Description of Artificial Sequence: Synthetic oligonucleotide
tgcgggacatggggatggtatggcggccagagaggcgtcgtcttc

SEQ ID NO: 1729 - DNA, 39 bp, Artificial Sequence
  Description of Artificial Sequence: Synthetic oligonucleotide
tgcggaacctggggaaccagcctgagtgcttgggtgttc

SEQ ID NO: 1730 - DNA, 39 bp, Artificial Sequence
  Description of Artificial Sequence: Synthetic oligonucleotide
tgcggaacctggggtagcagcctgactactggcctgttc

SEQ ID NO: 1731 - DNA, 39 bp, Artificial Sequence
  Description of Artificial Sequence: Synthetic oligonucleotide
tgcggaacatggggtagcagcctgactgcctatgtcttc

SEQ ID NO: 1732 - DNA, 36 bp, Artificial Sequence
  Description of Artificial Sequence: Synthetic oligonucleotide
tgcggaacatggggtagcagcctgagtgttgtgttc

SEQ ID NO: 1733 - DNA, 39 bp, Artificial Sequence
  Description of Artificial Sequence: Synthetic oligonucleotide
tgcggaacatggggtagcagcctgagtggtggggtgttc

SEQ ID NO: 1734 - DNA, 42 bp, Artificial Sequence
  Description of Artificial Sequence: Synthetic oligonucleotide
tgcggaacatggggtagcagcctgagtgcttattgggtgttc

SEQ ID NO: 1735 - DNA, 42 bp, Artificial Sequence
  Description of Artificial Sequence: Synthetic oligonucleotide
tgcggaacatggggtagcagcctgagtgcttatgtggtgttc

SEQ ID NO: 1736 - DNA, 39 bp, Artificial Sequence
  Description of Artificial Sequence: Synthetic oligonucleotide
tgcggaacatggggtagcagcctgagtgcttatgtcttc

SEQ ID NO: 1737 - DNA, 39 bp, Artificial Sequence
  Description of Artificial Sequence: Synthetic oligonucleotide
tgcggaacgtggggtagtagcctgagtgctgtggtgttc

SEQ ID NO: 1738 - DNA, 42 bp, Artificial Sequence
  Description of Artificial Sequence: Synthetic oligonucleotide
tgcggaacatggggtagcagcctgagtgctccttatgtcttc

SEQ ID NO: 1739 - DNA, 39 bp, Artificial Sequence
  Description of Artificial Sequence: Synthetic oligonucleotide
tgcggaacatggggtagcagcctgagtgccccggtgttc

SEQ ID NO: 1740 - DNA, 39 bp, Artificial Sequence
  Description of Artificial Sequence: Synthetic oligonucleotide
tgcggaacatggggtagcagcctgagtgctggggtgttc

SEQ ID NO: 1741 - DNA, 39 bp, Artificial Sequence
  Description of Artificial Sequence: Synthetic oligonucleotide
tgcggaacttggggtagcagcctgagtgctggactgttc

SEQ ID NO: 1742 - DNA, 42 bp, Artificial Sequence
  Description of Artificial Sequence: Synthetic oligonucleotide
tgcggaacatggggtagcagcctgagtgctggggcactcttc

SEQ ID NO: 1743 - DNA, 39 bp, Artificial Sequence
  Description of Artificial Sequence: Synthetic oligonucleotide
tgcggaacatggggcagtagcctgcgtgcttgggtgttc

SEQ ID NO: 1744 - DNA, 39 bp, Artificial Sequence
  Description of Artificial Sequence: Synthetic oligonucleotide
tgcggaacctggtttactagtctggctagtggggttttc

SEQ ID NO: 1745 - DNA, 39 bp, Artificial Sequence
  Description of Artificial Sequence: Synthetic oligonucleotide
tgcggaacttgggagaccagtctgagtgtcgtggtcatc

SEQ ID NO: 1746 - DNA, 36 bp, Artificial Sequence
  Description of Artificial Sequence: Synthetic oligonucleotide
tgcggaacatgggagaccagcctgagtggtgtcttc

SEQ ID NO: 1747 - DNA, 39 bp, Artificial Sequence
  Description of Artificial Sequence: Synthetic oligonucleotide
tgcggaacatgggaaaccagcctgagtgattgggtattc

SEQ ID NO: 1748 - DNA, 39 bp, Artificial Sequence
  Description of Artificial Sequence: Synthetic oligonucleotide
tgcggaacatgggagaccagcctgagtgctggggtattc

SEQ ID NO: 1749 - DNA, 39 bp, Artificial Sequence
  Description of Artificial Sequence: Synthetic oligonucleotide
tgcggaacatgggaaaccagccttaattatgtggccttc

SEQ ID NO: 1750 - DNA, 39 bp, Artificial Sequence
  Description of Artificial Sequence: Synthetic oligonucleotide
tgcggaacatgggagaccagcctgaatacttggttgctc

SEQ ID NO: 1751 - DNA, 42 bp, Artificial Sequence
  Description of Artificial Sequence: Synthetic oligonucleotide
tgcggaacatgggagaccagcgagagtggtaattacatcttc

SEQ ID NO: 1752 - DNA, 39 bp, Artificial Sequence
  Description of Artificial Sequence: Synthetic oligonucleotide
tgcggaacatgggaaaccagactgggtacttgggtgatc

SEQ ID NO: 1753 - DNA, 36 bp, Artificial Sequence
  Description of Artificial Sequence: Synthetic oligonucleotide
tgcggaacatgggagacccagttatattgggtgttc

SEQ ID NO: 1754 - DNA, 42 bp, Artificial Sequence
  Description of Artificial Sequence: Synthetic oligonucleotide
tgcggaacatgggagactggcctaagtgctggagaggtgttc

SEQ ID NO: 1755 - DNA, 39 bp, Artificial Sequence
  Description of Artificial Sequence: Synthetic oligonucleotide
tgcggaacttgggaaagcaccctgagtgttttcctattc

SEQ ID NO: 1756 - DNA, 39 bp, Artificial Sequence
  Description of Artificial Sequence: Synthetic oligonucleotide
tgcgggacatgggaaagtagcctgactgttgtggtcttc

SEQ ID NO: 1757 - DNA, 39 bp, Artificial Sequence
  Description of Artificial Sequence: Synthetic oligonucleotide
tgcggaacatgggaaagtagcctgactggagtggtattc

SEQ ID NO: 1758 - DNA, 39 bp, Artificial Sequence
  Description of Artificial Sequence: Synthetic oligonucleotide
tgcggaacatgggaaagcagcctgactggttttgtcttc

SEQ ID NO: 1759 - DNA, 39 bp, Artificial Sequence
  Description of Artificial Sequence: Synthetic oligonucleotide
tgtggaacatgggagagcagcctgagtgttggggtgttc

SEQ ID NO: 1760 - DNA, 39 bp, Artificial Sequence
  Description of Artificial Sequence: Synthetic oligonucleotide
tgcggaacctgggaaagtagcctcagtgaatgggtgttc

SEQ ID NO: 1761 - DNA, 36 bp, Artificial Sequence
  Description of Artificial Sequence: Synthetic oligonucleotide
tgcggaacatgggagagcagcctgagtgctgtattc

SEQ ID NO: 1762 - DNA, 42 bp, Artificial Sequence
  Description of Artificial Sequence: Synthetic oligonucleotide
tgcggaacatgggagagcagcctgagtgctggttatatcttc

SEQ ID NO: 1763 - DNA, 39 bp, Artificial Sequence
  Description of Artificial Sequence: Synthetic oligonucleotide
tgcggaacatgggagagcagcctgagtgctggagtgttc

SEQ ID NO: 1764 - DNA, 42 bp, Artificial Sequence
  Description of Artificial Sequence: Synthetic oligonucleotide
tgcggaacatgggaaagcagcctgagcgctggcccggtgttc

SEQ ID NO: 1765 - DNA, 45 bp, Artificial Sequence
  Description of Artificial Sequence: Synthetic oligonucleotide
tgcggaacatgggaaagcagcctgagtgctggaggccaggtgttc

SEQ ID NO: 1766 - DNA, 48 bp, Artificial Sequence
  Description of Artificial Sequence: Synthetic oligonucleotide
tgcggaacatgggagagcagcctgagtgccttcggcggttatgtcttc

SEQ ID NO: 1767 - DNA, 39 bp, Artificial Sequence
  Description of Artificial Sequence: Synthetic oligonucleotide
tgcggaacatgggaaagcagcctgagggtttgggtgttc

SEQ ID NO: 1768 - DNA, 45 bp, Artificial Sequence
  Description of Artificial Sequence: Synthetic oligonucleotide
tgcggaacatgggaaagcagcctctttactgggccttgggtgttc

SEQ ID NO: 1769 - DNA, 39 bp, Artificial Sequence
  Description of Artificial Sequence: Synthetic oligonucleotide
tgcggaacatgggagagcctgagtgccacctatgtcttc

SEQ ID NO: 1770 - DNA, 39 bp, Artificial Sequence
  Description of Artificial Sequence: Synthetic oligonucleotide
tgcggaacatgggagagcggcctgagtgctggtgtcttc

SEQ ID NO: 1771 - DNA, 33 bp, Artificial Sequence
  Description of Artificial Sequence: Synthetic oligonucleotide
tgcggaacatgggaaagcgacttttgggtgttt

SEQ ID NO: 1772 - DNA, 39 bp, Artificial Sequence
  Description of Artificial Sequence: Synthetic oligonucleotide
tgcggtacatgggaaaacagactgagtgctgtggtcttc

SEQ ID NO: 1773 - DNA, 39 bp, Artificial Sequence
  Description of Artificial Sequence: Synthetic oligonucleotide
tgcggaacatgggaaaacagactgagtgccggggtattc

SEQ ID NO: 1774 - DNA, 42 bp, Artificial Sequence
  Description of Artificial Sequence: Synthetic oligonucleotide
tgcggaacatgggaaatcagcctgactacttctgtggtattc

SEQ ID NO: 1775 - DNA, 42 bp, Artificial Sequence
  Description of Artificial Sequence: Synthetic oligonucleotide
tgcggaacatgggaaatcagcctgagtacttctgtggtattc

SEQ ID NO: 1776 - DNA, 36 bp, Artificial Sequence
  Description of Artificial Sequence: Synthetic oligonucleotide
tgcggaacatgggaaggcagcctcagtgttgttttc

SEQ ID NO: 1777 - DNA, 33 bp, Artificial Sequence
  Description of Artificial Sequence: Synthetic oligonucleotide
tgcggaacatgggaaggcagcctgagggtgttc

SEQ ID NO: 1778 - DNA, 36 bp, Artificial Sequence
  Description of Artificial Sequence: Synthetic oligonucleotide
tgcggaacatgggagggcagcctgaggcacgtgttc

SEQ ID NO: 1779 - DNA, 42 bp, Artificial Sequence
  Description of Artificial Sequence: Synthetic oligonucleotide
tgcggaacatgggattacagccctgtacgtgctggggtgttc

SEQ ID NO: 1780 - DNA, 39 bp, Artificial Sequence
  Description of Artificial Sequence: Synthetic oligonucleotide
tgcggaacgtgggattacagcctgagtgtttatctcttc

SEQ ID NO: 1781 - DNA, 42 bp, Artificial Sequence
  Description of Artificial Sequence: Synthetic oligonucleotide
tgcggaacatgggattacagcctgagttctggcgtggtattc

SEQ ID NO: 1782 - DNA, 39 bp, Artificial Sequence
  Description of Artificial Sequence: Synthetic oligonucleotide
tgcggaacatgggattacagcctgagtgcctgggtgttc

SEQ ID NO: 1783 - DNA, 39 bp, Artificial Sequence
  Description of Artificial Sequence: Synthetic oligonucleotide
tgcggaacatgggattacagtctgagtgctgaggtgttc

SEQ ID NO: 1784 - DNA, 39 bp, Artificial Sequence
  Description of Artificial Sequence: Synthetic oligonucleotide
tgcggaacatgggattacagcctgcgtcgtgcgatattc

SEQ ID NO: 1785 - DNA, 39 bp, Artificial Sequence
  Description of Artificial Sequence: Synthetic oligonucleotide
tgcggaacatgggattggagcctcattcttcaattgttc

SEQ ID NO: 1786 - DNA, 39 bp, Artificial Sequence
  Description of Artificial Sequence: Synthetic oligonucleotide
tgcggaacatgggatgtcaccttgcatactggggtgttc

SEQ ID NO: 1787 - DNA, 39 bp, Artificial Sequence
  Description of Artificial Sequence: Synthetic oligonucleotide
tgcggaacatgggatgtcaccttgcatattggggtgttc

SEQ ID NO: 1788 - DNA, 39 bp, Artificial Sequence
  Description of Artificial Sequence: Synthetic oligonucleotide
tgcggaacatgggatgtcaccttgcatgctggggtgttc

SEQ ID NO: 1789 - DNA, 42 bp, Artificial Sequence
  Description of Artificial Sequence: Synthetic oligonucleotide
tgcggaacatgggatgtcagtttgtatagtggcggggtcttc

SEQ ID NO: 1790 - DNA, 39 bp, Artificial Sequence
  Description of Artificial Sequence: Synthetic oligonucleotide
tgtggaacatgggatgtcagcctgacttctttcgtcttc

SEQ ID NO: 1791 - DNA, 39 bp, Artificial Sequence
  Description of Artificial Sequence: Synthetic oligonucleotide
tgcggaacatgggatgtcagcctgagtgttggggtgctc

SEQ ID NO: 1792 - DNA, 45 bp, Artificial Sequence
  Description of Artificial Sequence: Synthetic oligonucleotide
tgcggaacgtgggatgtcagcctgagtgctggcgatgtagttttc

SEQ ID NO: 1793 - DNA, 39 bp, Artificial Sequence
  Description of Artificial Sequence: Synthetic oligonucleotide
tgcggaacatgggatgtcagcctgaatgtcgtggttttc

SEQ ID NO: 1794 - DNA, 39 bp, Artificial Sequence
  Description of Artificial Sequence: Synthetic oligonucleotide
tgcggaacatgggatgtcagcctgaatactcaggtgttc

SEQ ID NO: 1795 - DNA, 36 bp, Artificial Sequence
  Description of Artificial Sequence: Synthetic oligonucleotide
tgcggcacatgggatgtgagcctgggtgcgctgttc

SEQ ID NO: 1796 - DNA, 39 bp, Artificial Sequence
  Description of Artificial Sequence: Synthetic oligonucleotide
tgcggaacgtgggacgttaatctgaaaactgtcgttttc

SEQ ID NO: 1797 - DNA, 39 bp, Artificial Sequence
  Description of Artificial Sequence: Synthetic oligonucleotide
tgcggaacatgggatgtcatcctgagtgctgaggtattc

SEQ ID NO: 1798 - DNA, 39 bp, Artificial Sequence
  Description of Artificial Sequence: Synthetic oligonucleotide
tgcggaacatgggataccaccgtgagtgctgtggttttc

SEQ ID NO: 1799 - DNA, 39 bp, Artificial Sequence
  Description of Artificial Sequence: Synthetic oligonucleotide
tgcggaacatgggataccaccctgactgcctgggtgttc

SEQ ID NO: 1800 - DNA, 39 bp, Artificial Sequence
  Description of Artificial Sequence: Synthetic oligonucleotide
tgcggaacatgggacaccaccttgagtgttttcctattc

SEQ ID NO: 1801 - DNA, 39 bp, Artificial Sequence
  Description of Artificial Sequence: Synthetic oligonucleotide
tgcgggacttgggataccagtgtgagtgctggggtgttc

SEQ ID NO: 1802 - DNA, 39 bp, Artificial Sequence
  Description of Artificial Sequence: Synthetic oligonucleotide
tgcggaacatgggataccagtgtgatttcttgggttttc

SEQ ID NO: 1803 - DNA, 45 bp, Artificial Sequence
  Description of Artificial Sequence: Synthetic oligonucleotide
tgcggaacatgggataccagtcggagttctctctatgtggtcttc

SEQ ID NO: 1804 - DNA, 39 bp, Artificial Sequence
  Description of Artificial Sequence: Synthetic oligonucleotide
tgcggaacatgggataccagccggagtgcttgggtattc

SEQ ID NO: 1805 - DNA, 42 bp, Artificial Sequence
  Description of Artificial Sequence: Synthetic oligonucleotide
tgcggaacatgggataccagccggaatcctggaggaattttc

SEQ ID NO: 1806 - DNA, 36 bp, Artificial Sequence
  Description of Artificial Sequence: Synthetic oligonucleotide
tgcggaacatgggacaccagtcggggtcatgttttc

SEQ ID NO: 1807 - DNA, 45 bp, Artificial Sequence
  Description of Artificial Sequence: Synthetic oligonucleotide
tgcggaacatgggataccagcccgagtactggccaggtgcttttc

SEQ ID NO: 1808 - DNA, 39 bp, Artificial Sequence
  Description of Artificial Sequence: Synthetic oligonucleotide
tgcggaacatgggataccagcccgagtgcctgggtgttc

SEQ ID NO: 1809 - DNA, 36 bp, Artificial Sequence
  Description of Artificial Sequence: Synthetic oligonucleotide
tgcggaacatgggatactagcctgacctgggtgttc

SEQ ID NO: 1810 - DNA, 42 bp, Artificial Sequence
  Description of Artificial Sequence: Synthetic oligonucleotide
tgcggaacatgggataccagcctgacgtggttcgcagtgttc

SEQ ID NO: 1811 - DNA, 39 bp, Artificial Sequence
  Description of Artificial Sequence: Synthetic oligonucleotide
tgcggaacatgggataccagcctgactgttgtggtattc

SEQ ID NO: 1812 - DNA, 42 bp, Artificial Sequence
  Description of Artificial Sequence: Synthetic oligonucleotide
tgcggaacatgggataccagcctgactacttcttgggtgttc

SEQ ID NO: 1813 - DNA, 48 bp, Artificial Sequence
  Description of Artificial Sequence: Synthetic oligonucleotide
tgcggaacatgggataccagcctgaccactggtcctttttgggtgttc

SEQ ID NO: 1814 - DNA, 42 bp, Artificial Sequence
  Description of Artificial Sequence: Synthetic oligonucleotide
tgcggaacatgggataccagcctgactcctttttatgtcttc

SEQ ID NO: 1815 - DNA, 39 bp, Artificial Sequence
  Description of Artificial Sequence: Synthetic oligonucleotide
tgcggaacatgggataccagcctgactgcttatgtcttc

SEQ ID NO: 1816 - DNA, 39 bp, Artificial Sequence
  Description of Artificial Sequence: Synthetic oligonucleotide
tgcggaacatgggataccagcctgactgcttgggtgttc

SEQ ID NO: 1817 - DNA, 42 bp, Artificial Sequence
  Description of Artificial Sequence: Synthetic oligonucleotide
tgcggaacatgggataccagcctgactgcgtggggggtgttc

SEQ ID NO: 1818 - DNA, 39 bp, Artificial Sequence
  Description of Artificial Sequence: Synthetic oligonucleotide
tgcggcacatgggataccagcctgactgcggtggttctc

SEQ ID NO: 1819 - DNA, 39 bp, Artificial Sequence
  Description of Artificial Sequence: Synthetic oligonucleotide
tgcggaacctgggataccagcctgactgctcgggttttc

SEQ ID NO: 1820 - DNA, 39 bp, Artificial Sequence
  Description of Artificial Sequence: Synthetic oligonucleotide
tgcggaacatgggataccagcctgactgcgattgtcttc

SEQ ID NO: 1821 - DNA, 39 bp, Artificial Sequence
  Description of Artificial Sequence: Synthetic oligonucleotide
tgcggaacatgggataccagcctgactgctggtgtcttc

SEQ ID NO: 1822 - DNA, 39 bp, Artificial Sequence
  Description of Artificial Sequence: Synthetic oligonucleotide
tgcggaacatgggataccagcctgagtgtttatgtcttc

SEQ ID NO: 1823 - DNA, 36 bp, Artificial Sequence
  Description of Artificial Sequence: Synthetic oligonucleotide
tgcggaacatgggataccagcctgagtgtggtgttc

SEQ ID NO: 1824 - DNA, 39 bp, Artificial Sequence
  Description of Artificial Sequence: Synthetic oligonucleotide
tgcgggacatgggataccagcctgagtgttggggaattc

SEQ ID NO: 1825 - DNA, 39 bp, Artificial Sequence
  Description of Artificial Sequence: Synthetic oligonucleotide
tgcggaacatgggataccagcctgagtacttgggtgttc

SEQ ID NO: 1826 - DNA, 39 bp, Artificial Sequence
  Description of Artificial Sequence: Synthetic oligonucleotide
tgcggaacatgggataccagcctgagtactgtggtattc

SEQ ID NO: 1827 - DNA, 45 bp, Artificial Sequence
  Description of Artificial Sequence: Synthetic oligonucleotide
tgcggaacatgggataccagcctgagtactggccaggtgcttttc

SEQ ID NO: 1828 - DNA, 48 bp, Artificial Sequence
  Description of Artificial Sequence: Synthetic oligonucleotide
tgcggcacatgggataccagcctgagcactggtcctctttgggtgttc

SEQ ID NO: 1829 - DNA, 39 bp, Artificial Sequence
  Description of Artificial Sequence: Synthetic oligonucleotide
tgcggaacttgggataccagcctgagttcttatgtcttc

SEQ ID NO: 1830 - DNA, 39 bp, Artificial Sequence
  Description of Artificial Sequence: Synthetic oligonucleotide
tgcggaacatgggataccagcctgagttctgtggtcttc

SEQ ID NO: 1831 - DNA, 42 bp, Artificial Sequence
  Description of Artificial Sequence: Synthetic oligonucleotide
tgcggaacatgggataccagcctgagttctagatacatattc

SEQ ID NO: 1832 - DNA, 42 bp, Artificial Sequence
  Description of Artificial Sequence: Synthetic oligonucleotide
tgcggaacatgggataccagcctgagttctagattcatattc

SEQ ID NO: 1833 - DNA, 42 bp, Artificial Sequence
  Description of Artificial Sequence: Synthetic oligonucleotide
tgcggaacatgggataccagcctgagttctgggtgggtgttc

SEQ ID NO: 1834 - DNA, 39 bp, Artificial Sequence
  Description of Artificial Sequence: Synthetic oligonucleotide
tgcggaacatgggataccagcctgagtcggtatgtgttc

SEQ ID NO: 1835 - DNA, 39 bp, Artificial Sequence
  Description of Artificial Sequence: Synthetic oligonucleotide
tgcggaacttgggataccagtctgagtcaatggctgttc

SEQ ID NO: 1836 - DNA, 45 bp, Artificial Sequence
  Description of Artificial Sequence: Synthetic oligonucleotide
tgcggaacatgggataccagcctgagtcctggcctttgggtgttc

SEQ ID NO: 1837 - DNA, 39 bp, Artificial Sequence
  Description of Artificial Sequence: Synthetic oligonucleotide
tgcggaacatgggataccagcctgagtaattatgtcttc

SEQ ID NO: 1838 - DNA, 39 bp, Artificial Sequence
  Description of Artificial Sequence: Synthetic oligonucleotide
tgcggaacatgggataccagcctaagtatttgggtgttc

SEQ ID NO: 1839 - DNA, 48 bp, Artificial Sequence
  Description of Artificial Sequence: Synthetic oligonucleotide
tgcggcacatgggataccagcctgagcattggtcctttttgggtgttc

SEQ ID NO: 1840 - DNA, 39 bp, Artificial Sequence
  Description of Artificial Sequence: Synthetic oligonucleotide
tgcggaacatgggataccagcctgagtggttgggtgttc

SEQ ID NO: 1841 - DNA, 39 bp, Artificial Sequence
  Description of Artificial Sequence: Synthetic oligonucleotide
tgcggaacatgggataccagcctgagtggtacagtgttc

SEQ ID NO: 1842 - DNA, 42 bp, Artificial Sequence
  Description of Artificial Sequence: Synthetic oligonucleotide
tgcggaacatgggatactagtctgagtggtggccaggtgttc

SEQ ID NO: 1843 - DNA, 39 bp, Artificial Sequence
  Description of Artificial Sequence: Synthetic oligonucleotide
tgcggaacatgggataccagcctgagtggtgggatattc

SEQ ID NO: 1844 - DNA, 45 bp, Artificial Sequence
  Description of Artificial Sequence: Synthetic oligonucleotide
tgcggaacatgggataccagcctgagtggtgaggatgtggtaatc

SEQ ID NO: 1845 - DNA, 42 bp, Artificial Sequence
  Description of Artificial Sequence: Synthetic oligonucleotide
tgcggaacatgggataccagcctgagtttcctttatgctttc

SEQ ID NO: 1846 - DNA, 39 bp, Artificial Sequence
  Description of Artificial Sequence: Synthetic oligonucleotide
tgcggaacatgggataccagcctgagtgaggtcgtattc

SEQ ID NO: 1847 - DNA, 36 bp, Artificial Sequence
  Description of Artificial Sequence: Synthetic oligonucleotide
tgcggaacatgggataccagcctgagtgaagtgttc

SEQ ID NO: 1848 - DNA, 42 bp, Artificial Sequence
  Description of Artificial Sequence: Synthetic oligonucleotide
tgcggaacatgggatactagcctgagtgaaaattgggtgttc

SEQ ID NO: 1849 - DNA, 39 bp, Artificial Sequence
  Description of Artificial Sequence: Synthetic oligonucleotide
tgcggaacatgggataccagcctgagtgcctacatattc

SEQ ID NO: 1850 - DNA, 39 bp, Artificial Sequence
  Description of Artificial Sequence: Synthetic oligonucleotide
tgcggaacatgggataccagcctgagtgctgtggtactc

SEQ ID NO: 1851 - DNA, 36 bp, Artificial Sequence
  Description of Artificial Sequence: Synthetic oligonucleotide
tgcggaacatgggataccagcctgagtgctgttttc

SEQ ID NO: 1852 - DNA, 39 bp, Artificial Sequence
  Description of Artificial Sequence: Synthetic oligonucleotide
tgcggaacatgggataccagcctgagtgcccgggtgttc

SEQ ID NO: 1853 - DNA, 42 bp, Artificial Sequence
  Description of Artificial Sequence: Synthetic oligonucleotide
tgcggcacatgggataccagcctgagtgcccgccaggtattc

SEQ ID NO: 1854 - DNA, 39 bp, Artificial Sequence
  Description of Artificial Sequence: Synthetic oligonucleotide
tgcggaacatgggataccagcctgagtgctttggttttc

SEQ ID NO: 1855 - DNA, 39 bp, Artificial Sequence
  Description of Artificial Sequence: Synthetic oligonucleotide
tgcggaacatgggataccagcctgagtgctaaggtgttc

SEQ ID NO: 1856 - DNA, 39 bp, Artificial Sequence
  Description of Artificial Sequence: Synthetic oligonucleotide
tgcggaacatgggataccagcctgagtgcgaaaatcttc

SEQ ID NO: 1857 - DNA, 42 bp, Artificial Sequence
  Description of Artificial Sequence: Synthetic oligonucleotide
tgcggaacatgggataccagcctgagtgccaaggcggtattc

SEQ ID NO: 1858 - DNA, 42 bp, Artificial Sequence
  Description of Artificial Sequence: Synthetic oligonucleotide
tgcggaacatgggataccagcctgagtgcccatgctgtgttc

SEQ ID NO: 1859 - DNA, 42 bp, Artificial Sequence
  Description of Artificial Sequence: Synthetic oligonucleotide
tgcggaacatgggataccagcctgagtgctggctatgtcttc

SEQ ID NO: 1860 - DNA, 45 bp, Artificial Sequence
  Description of Artificial Sequence: Synthetic oligonucleotide
tgcggaacatgggacaccagtctgagtgctggccgctgggtgttc

SEQ ID NO: 1861 - DNA, 39 bp, Artificial Sequence
  Description of Artificial Sequence: Synthetic oligonucleotide
tgcggaacatgggataccagcctgagtgctgggatattc

SEQ ID NO: 1862 - DNA, 48 bp, Artificial Sequence
  Description of Artificial Sequence: Synthetic oligonucleotide
tgcggaacatgggataccagcctgagtgctggtgggttccgggtcttc

SEQ ID NO: 1863 - DNA, 39 bp, Artificial Sequence
  Description of Artificial Sequence: Synthetic oligonucleotide
tgcggaacatgggataccagcctgagtgctggggcattc

SEQ ID NO: 1864 - DNA, 42 bp, Artificial Sequence
  Description of Artificial Sequence: Synthetic oligonucleotide
tgcggaacatgggataccagtctgagtgctgattggtttttc

SEQ ID NO: 1865 - DNA, 45 bp, Artificial Sequence
  Description of Artificial Sequence: Synthetic oligonucleotide
tgcggaacatgggataccagcctgagtgctgatgaatatgtcttc

SEQ ID NO: 1866 - DNA, 42 bp, Artificial Sequence
  Description of Artificial Sequence: Synthetic oligonucleotide
tgcggcacatgggataccagcctgagtgcggcttgggtgttc

SEQ ID NO: 1867 - DNA, 39 bp, Artificial Sequence
  Description of Artificial Sequence: Synthetic oligonucleotide
tgcggaacatgggataccagcctgagtgctgcgctattc

SEQ ID NO: 1868 - DNA, 42 bp, Artificial Sequence
  Description of Artificial Sequence: Synthetic oligonucleotide
tgcggaacatgggataccagcctgagtgctgcgggggttttc

SEQ ID NO: 1869 - DNA, 39 bp, Artificial Sequence
  Description of Artificial Sequence: Synthetic oligonucleotide
tgcggaacatgggataccagcctgagagttgtggttttc

SEQ ID NO: 1870 - DNA, 39 bp, Artificial Sequence
  Description of Artificial Sequence: Synthetic oligonucleotide
tgcggaacatgggataccagcctgagaacctgggtattc

SEQ ID NO: 1871 - DNA, 39 bp, Artificial Sequence
  Description of Artificial Sequence: Synthetic oligonucleotide
tgcggaacgtgggataccagcctgaggggtgcagtgttc

SEQ ID NO: 1872 - DNA, 39 bp, Artificial Sequence
  Description of Artificial Sequence: Synthetic oligonucleotide
tgcggaacatgggataccagcctgcgtgctgtggtattc

SEQ ID NO: 1873 - DNA, 42 bp, Artificial Sequence
  Description of Artificial Sequence: Synthetic oligonucleotide
tgcggaacatgggatacaagcctgaatgtagtttatgtcttc

SEQ ID NO: 1874 - DNA, 39 bp, Artificial Sequence
  Description of Artificial Sequence: Synthetic oligonucleotide
tgcggaacatgggataccagcctcaacacctacctgttc

SEQ ID NO: 1875 - DNA, 42 bp, Artificial Sequence
  Description of Artificial Sequence: Synthetic oligonucleotide
tgcggaacatgggatactagcctgaacttcgcttggctgttc

SEQ ID NO: 1876 - DNA, 39 bp, Artificial Sequence
  Description of Artificial Sequence: Synthetic oligonucleotide
tgcggcacatgggataccagccttcttgtgtggcttttc

SEQ ID NO: 1877 - DNA, 39 bp, Artificial Sequence
  Description of Artificial Sequence: Synthetic oligonucleotide
tgcggaacatgggataccagtctgaagacgtgggtgttc

SEQ ID NO: 1878 - DNA, 39 bp, Artificial Sequence
  Description of Artificial Sequence: Synthetic oligonucleotide
tgcggaacatgggataccagtctgattgtctgggtgttc

SEQ ID NO: 1879 - DNA, 39 bp, Artificial Sequence
  Description of Artificial Sequence: Synthetic oligonucleotide
tgcggaacatgggataccagcctaattactggggtgttc

SEQ ID NO: 1880 - DNA, 39 bp, Artificial Sequence
  Description of Artificial Sequence: Synthetic oligonucleotide
tgcggaacatgggataccagcctgattagcgtggtattc

SEQ ID NO: 1881 - DNA, 39 bp, Artificial Sequence
  Description of Artificial Sequence: Synthetic oligonucleotide
tgcggaacatgggataccagcctgattgcttatgtcttc

SEQ ID NO: 1882 - DNA, 39 bp, Artificial Sequence
  Description of Artificial Sequence: Synthetic oligonucleotide
tgcggaacatgggataccagcctgcacactgagttgttc

SEQ ID NO: 1883 - DNA, 39 bp, Artificial Sequence
  Description of Artificial Sequence: Synthetic oligonucleotide
tgcggaacttgggataccagcctgggttcttatgtcttc

SEQ ID NO: 1884 - DNA, 42 bp, Artificial Sequence
  Description of Artificial Sequence: Synthetic oligonucleotide
tgcggaacatgggataccagcctgggttctctttgggtgttc

SEQ ID NO: 1885 - DNA, 39 bp, Artificial Sequence
  Description of Artificial Sequence: Synthetic oligonucleotide
tgcggtacatgggataccagcctgggttctggggtattc

SEQ ID NO: 1886 - DNA, 42 bp, Artificial Sequence
  Description of Artificial Sequence: Synthetic oligonucleotide
tgcggaacttgggataccagtctgggtggtagaggggtcttc

SEQ ID NO: 1887 - DNA, 39 bp, Artificial Sequence
  Description of Artificial Sequence: Synthetic oligonucleotide
tgcggaacatgggataccagcctgggtgcttgggtgttc

SEQ ID NO: 1888 - DNA, 39 bp, Artificial Sequence
  Description of Artificial Sequence: Synthetic oligonucleotide
tgcggaacatgggataccagcctgggtgccgtggtattc

SEQ ID NO: 1889 - DNA, 39 bp, Artificial Sequence
  Description of Artificial Sequence: Synthetic oligonucleotide
tgcggaacatgggataccagcctgggtgctggggtattc

SEQ ID NO: 1890 - DNA, 39 bp, Artificial Sequence
  Description of Artificial Sequence: Synthetic oligonucleotide
tgcggaacatgggataccagcctgggtgctggcctattc

SEQ ID NO: 1891 - DNA, 39 bp, Artificial Sequence
  Description of Artificial Sequence: Synthetic oligonucleotide
tgcggaacatgggataccagtctggatgctgtggttttc

SEQ ID NO: 1892 - DNA, 39 bp, Artificial Sequence
  Description of Artificial Sequence: Synthetic oligonucleotide
tgcgggacttgggataccagcctggatgctgtgctgttc

SEQ ID NO: 1893 - DNA, 36 bp, Artificial Sequence
  Description of Artificial Sequence: Synthetic oligonucleotide
tgcggaacatgggataccagcctggcttgggtgttc

SEQ ID NO: 1894 - DNA, 39 bp, Artificial Sequence
  Description of Artificial Sequence: Synthetic oligonucleotide
tgcggaacatgggataccagcctggcgactggactgttc

SEQ ID NO: 1895 - DNA, 39 bp, Artificial Sequence
  Description of Artificial Sequence: Synthetic oligonucleotide
tgcgggacatgggataccagcctggcccctgtagtcttc

SEQ ID NO: 1896 - DNA, 39 bp, Artificial Sequence
  Description of Artificial Sequence: Synthetic oligonucleotide
tgcggaacatgggacacccgcctgactattgtgatcttc

SEQ ID NO: 1897 - DNA, 39 bp, Artificial Sequence
  Description of Artificial Sequence: Synthetic oligonucleotide
tgtggaacatgggacaccaggctgagtgtttggctgttc

SEQ ID NO: 1898 - DNA, 39 bp, Artificial Sequence
  Description of Artificial Sequence: Synthetic oligonucleotide
tgcggaacgtgggacaccagactgagtgttggggttttc

SEQ ID NO: 1899 - DNA, 39 bp, Artificial Sequence
  Description of Artificial Sequence: Synthetic oligonucleotide
tgcggcacatgggataccagactgagtactgtaattttc

SEQ ID NO: 1900 - DNA, 39 bp, Artificial Sequence
  Description of Artificial Sequence: Synthetic oligonucleotide
tgcggaacatgggatacccgcctgagttctgtggtcttc

SEQ ID NO: 1901 - DNA, 39 bp, Artificial Sequence
  Description of Artificial Sequence: Synthetic oligonucleotide
tgcggaacatgggatacccgcctgagtattgtggttttc

SEQ ID NO: 1902 - DNA, 42 bp, Artificial Sequence
  Description of Artificial Sequence: Synthetic oligonucleotide
tgcggaacatgggataccagactgagtgcctatgtggtattc

SEQ ID NO: 1903 - DNA, 39 bp, Artificial Sequence
  Description of Artificial Sequence: Synthetic oligonucleotide
tgcggaacctgggacacccgcctgagtgcgtgggtgttc

SEQ ID NO: 1904 - DNA, 39 bp, Artificial Sequence
  Description of Artificial Sequence: Synthetic oligonucleotide
tgcggaacatgggataccagactgagtgctgtggtgttc

SEQ ID NO: 1905 - DNA, 39 bp, Artificial Sequence
  Description of Artificial Sequence: Synthetic oligonucleotide
tgcggaacatgggatacccgcctgagtgctgggttgttc

SEQ ID NO: 1906 - DNA, 42 bp, Artificial Sequence
  Description of Artificial Sequence: Synthetic oligonucleotide
tgcggaacatgggataccagactgagtgctggtggggtgttc

SEQ ID NO: 1907 - DNA, 39 bp, Artificial Sequence
  Description of Artificial Sequence: Synthetic oligonucleotide
tgcggaacatgggataccagattgaatgtgtggctattc

SEQ ID NO: 1908 - DNA, 39 bp, Artificial Sequence
  Description of Artificial Sequence: Synthetic oligonucleotide
tgcggaacatgggataccaaccgggaagttgtgctcctc

SEQ ID NO: 1909 - DNA, 39 bp, Artificial Sequence
  Description of Artificial Sequence: Synthetic oligonucleotide
tgcggaacatgggataccaacctgcgtgcccatgtcttc

SEQ ID NO: 1910 - DNA, 39 bp, Artificial Sequence
  Description of Artificial Sequence: Synthetic oligonucleotide
tgcggaacatgggatactaatctgcccgctgtagtgttc

SEQ ID NO: 1911 - DNA, 36 bp, Artificial Sequence
  Description of Artificial Sequence: Synthetic oligonucleotide
tgcggaacatgggacaccaatttgggtggggtgttc

SEQ ID NO: 1912 - DNA, 39 bp, Artificial Sequence
  Description of Artificial Sequence: Synthetic oligonucleotide
tgcggaacatgggataccatcgtgagtattggggtgttc

SEQ ID NO: 1913 - DNA, 39 bp, Artificial Sequence
  Description of Artificial Sequence: Synthetic oligonucleotide
tgcggaacatgggataccatcctgagtgcggtggtgttc

SEQ ID NO: 1914 - DNA, 39 bp, Artificial Sequence
  Description of Artificial Sequence: Synthetic oligonucleotide
tgcggcacatgggataccatcctgagtgctgaggtgttc

SEQ ID NO: 1915 - DNA, 36 bp, Artificial Sequence
  Description of Artificial Sequence: Synthetic oligonucleotide
tgcggaacatgggatacccacctgggtgtggttttc

SEQ ID NO: 1916 - DNA, 42 bp, Artificial Sequence
  Description of Artificial Sequence: Synthetic oligonucleotide
tgcggaacatgggataccggcccgagccctcattggctgttc

SEQ ID NO: 1917 - DNA, 42 bp, Artificial Sequence
  Description of Artificial Sequence: Synthetic oligonucleotide
tgcggaacatgggataccggcctgacttttggaggcgtgttc

SEQ ID NO: 1918 - DNA, 39 bp, Artificial Sequence
  Description of Artificial Sequence: Synthetic oligonucleotide
tgcggaacatgggataccggcctgactgcttttgtcttc

SEQ ID NO: 1919 - DNA, 39 bp, Artificial Sequence
  Description of Artificial Sequence: Synthetic oligonucleotide
tgcggaacatgggataccggcctgagtgtttgggtgttc

SEQ ID NO: 1920 - DNA, 39 bp, Artificial Sequence
  Description of Artificial Sequence: Synthetic oligonucleotide
tgcggaacatgggataccggcctgagtactgggattttc

SEQ ID NO: 1921 - DNA, 39 bp, Artificial Sequence
  Description of Artificial Sequence: Synthetic oligonucleotide
tgcggaacatgggataccggcctgagttccctgctcttc

SEQ ID NO: 1922 - DNA, 39 bp, Artificial Sequence
  Description of Artificial Sequence: Synthetic oligonucleotide
tgcggaacgtgggacaccggcctgagtattgtggtgttc

SEQ ID NO: 1923 - DNA, 39 bp, Artificial Sequence
  Description of Artificial Sequence: Synthetic oligonucleotide
tgcggaacgtgggacaccggcctgagttttgtggtgttc

SEQ ID NO: 1924 - DNA, 39 bp, Artificial Sequence
  Description of Artificial Sequence: Synthetic oligonucleotide
tgcggaacatgggataccggcctgagtgcttgggtgttc

SEQ ID NO: 1925 - DNA, 42 bp, Artificial Sequence
  Description of Artificial Sequence: Synthetic oligonucleotide
tgcggaacatgggataccggcctgagtgctggtgtggtattc

SEQ ID NO: 1926 - DNA, 39 bp, Artificial Sequence
  Description of Artificial Sequence: Synthetic oligonucleotide
tgcggaacatgggataccggtctgaggggttggattttc

SEQ ID NO: 1927 - DNA, 39 bp, Artificial Sequence
  Description of Artificial Sequence: Synthetic oligonucleotide
tgcggaacatgggataccgagctaagtgcgggggtcttc

SEQ ID NO: 1928 - DNA, 39 bp, Artificial Sequence
  Description of Artificial Sequence: Synthetic oligonucleotide
tgcggaacgtgggataccgccctgactgctggggtgttc

SEQ ID NO: 1929 - DNA, 39 bp, Artificial Sequence
  Description of Artificial Sequence: Synthetic oligonucleotide
tgcggaacatgggatactgccctgagtcttgtggtcttc

SEQ ID NO: 1930 - DNA, 39 bp, Artificial Sequence
  Description of Artificial Sequence: Synthetic oligonucleotide
tgcggaacatgggataccgccctgagtgcctggctgttc

SEQ ID NO: 1931 - DNA, 39 bp, Artificial Sequence
  Description of Artificial Sequence: Synthetic oligonucleotide
tgcggcacatgggataccgccctgagtgctggggtgttc

SEQ ID NO: 1932 - DNA, 39 bp, Artificial Sequence
  Description of Artificial Sequence: Synthetic oligonucleotide
tgcggaacatgggataccgccctgcgtggcgtgctgttc

SEQ ID NO: 1933 - DNA, 39 bp, Artificial Sequence
  Description of Artificial Sequence: Synthetic oligonucleotide
tgcggaacatgggataccgccctgaaagaatggctgttc

SEQ ID NO: 1934 - DNA, 45 bp, Artificial Sequence
  Description of Artificial Sequence: Synthetic oligonucleotide
tgcggaacatgggataggaccctgactgctggcgatgtgctcttc

SEQ ID NO: 1935 - DNA, 36 bp, Artificial Sequence
  Description of Artificial Sequence: Synthetic oligonucleotide
tgcggaacatgggatagaagcgtgacttatgtcttc

SEQ ID NO: 1936 - DNA, 39 bp, Artificial Sequence
  Description of Artificial Sequence: Synthetic oligonucleotide
tgcggaacatgggatcgcagccgaaatgaatgggtgttc

SEQ ID NO: 1937 - DNA, 39 bp, Artificial Sequence
  Description of Artificial Sequence: Synthetic oligonucleotide
tgcggaacatgggatcgcagtctgactgtttgggtcttc

SEQ ID NO: 1938 - DNA, 42 bp, Artificial Sequence
  Description of Artificial Sequence: Synthetic oligonucleotide
tgcggaacatgggatcgcagcctgactcctgggtggttgttc

SEQ ID NO: 1939 - DNA, 39 bp, Artificial Sequence
  Description of Artificial Sequence: Synthetic oligonucleotide
tgcggaacatgggatagaagcctgactgcttgggtgttc

SEQ ID NO: 1940 - DNA, 39 bp, Artificial Sequence
  Description of Artificial Sequence: Synthetic oligonucleotide
tgcggaacatgggaccgcagcctgagtgttgtggtattc

SEQ ID NO: 1941 - DNA, 36 bp, Artificial Sequence
  Description of Artificial Sequence: Synthetic oligonucleotide
tgcggcacatgggatcgcagcctgagtgtagtcttc

SEQ ID NO: 1942 - DNA, 39 bp, Artificial Sequence
  Description of Artificial Sequence: Synthetic oligonucleotide
tgcggaacatgggataggagcctgagtgttcaattgttc

SEQ ID NO: 1943 - DNA, 42 bp, Artificial Sequence
  Description of Artificial Sequence: Synthetic oligonucleotide
tgcggaacatgggatcgcagcctcagtgttctttgggtgttc

SEQ ID NO: 1944 - DNA, 39 bp, Artificial Sequence
  Description of Artificial Sequence: Synthetic oligonucleotide
tgcggaacatgggatcgcagcctgagtgttggattattc

SEQ ID NO: 1945 - DNA, 39 bp, Artificial Sequence
  Description of Artificial Sequence: Synthetic oligonucleotide
tgcggaacatgggatcgcagcctgagtacttgggtgttc

SEQ ID NO: 1946 - DNA, 42 bp, Artificial Sequence
  Description of Artificial Sequence: Synthetic oligonucleotide
tgcggaacatgggatagaagcctgagtactcattgggtgctc

SEQ ID NO: 1947 - DNA, 42 bp, Artificial Sequence
  Description of Artificial Sequence: Synthetic oligonucleotide
tgcggaacatgggatagaagcctgagtactcattgggtgttc

SEQ ID NO: 1948 - DNA, 39 bp, Artificial Sequence
  Description of Artificial Sequence: Synthetic oligonucleotide
tgcggaacctgggatcgaagcctgagttctgcggtgttc

SEQ ID NO: 1949 - DNA, 42 bp, Artificial Sequence
  Description of Artificial Sequence: Synthetic oligonucleotide
tgcggaacatgggacagaagcctgagtccctcttatgtcttc

SEQ ID NO: 1950 - DNA, 39 bp, Artificial Sequence
  Description of Artificial Sequence: Synthetic oligonucleotide
tgcggaacatgggataggagcctgagtggtgaggtgttc

SEQ ID NO: 1951 - DNA, 39 bp, Artificial Sequence
  Description of Artificial Sequence: Synthetic oligonucleotide
tgcggaacatgggataggagcctgagtggtgcggtgttc

SEQ ID NO: 1952 - DNA, 39 bp, Artificial Sequence
  Description of Artificial Sequence: Synthetic oligonucleotide
tgcggaacatgggatcgcagcctgagtgctgtggcattc

SEQ ID NO: 1953 - DNA, 42 bp, Artificial Sequence
  Description of Artificial Sequence: Synthetic oligonucleotide
tgcggaacatgggataggagcctgagtgccgggggggaattc

SEQ ID NO: 1954 - DNA, 42 bp, Artificial Sequence
  Description of Artificial Sequence: Synthetic oligonucleotide
tgcggaacatgggatcgcagcctgagtgctttttgggtgttc

SEQ ID NO: 1955 - DNA, 39 bp, Artificial Sequence
  Description of Artificial Sequence: Synthetic oligonucleotide
tgcggaacatgggataggagcctgagtgctgcggtgttc

SEQ ID NO: 1956 - DNA, 39 bp, Artificial Sequence
  Description of Artificial Sequence: Synthetic oligonucleotide
tgcggaacatgggataggagcctgagtgctgcactcttc

SEQ ID NO: 1957 - DNA, 33 bp, Artificial Sequence
  Description of Artificial Sequence: Synthetic oligonucleotide
tgcggaacatgggatcgcagcctgagagtgttc

SEQ ID NO: 1958 - DNA, 36 bp, Artificial Sequence
  Description of Artificial Sequence: Synthetic oligonucleotide
tgcggtacatgggacagaagccttaattgggtgttc

SEQ ID NO: 1959 - DNA, 39 bp, Artificial Sequence
  Description of Artificial Sequence: Synthetic oligonucleotide
tgcggaacatgggatcgcagcctgaatgtttatgtcttc

SEQ ID NO: 1960 - DNA, 39 bp, Artificial Sequence
  Description of Artificial Sequence: Synthetic oligonucleotide
tgcggaacatgggataggagcctgaatgttggggtgttc

SEQ ID NO: 1961 - DNA, 36 bp, Artificial Sequence
  Description of Artificial Sequence: Synthetic oligonucleotide
tgcggaacatgggatcggagcctgcatgtggtcttc

SEQ ID NO: 1962 - DNA, 39 bp, Artificial Sequence
  Description of Artificial Sequence: Synthetic oligonucleotide
tgtggaacatgggatcgcagcctgggtggttgggtgttc

SEQ ID NO: 1963 - DNA, 42 bp, Artificial Sequence
  Description of Artificial Sequence: Synthetic oligonucleotide
tgcggaacatgggatcgcagcctgggtgctttttgggtgttc

SEQ ID NO: 1964 - DNA, 36 bp, Artificial Sequence
  Description of Artificial Sequence: Synthetic oligonucleotide
tgcggaacatgggatagaagcctgttttgggtgttc

SEQ ID NO: 1965 - DNA, 39 bp, Artificial Sequence
  Description of Artificial Sequence: Synthetic oligonucleotide
tgcggaacgtgggatcgcagcctggctgctggggtgttc

SEQ ID NO: 1966 - DNA, 39 bp, Artificial Sequence
  Description of Artificial Sequence: Synthetic oligonucleotide
tgcggaacatgggataggaggttgagtggtgtcgtattc

SEQ ID NO: 1967 - DNA, 39 bp, Artificial Sequence
  Description of Artificial Sequence: Synthetic oligonucleotide
tgcggaacgtgggatcgccgcctaagtgatgtggtattc

SEQ ID NO: 1968 - DNA, 39 bp, Artificial Sequence
  Description of Artificial Sequence: Synthetic oligonucleotide
tgcggaacatgggataggaggctgagtgctgtggtattc

SEQ ID NO: 1969 - DNA, 39 bp, Artificial Sequence
  Description of Artificial Sequence: Synthetic oligonucleotide
tgcggaacatgggatagacgcctgaatgttgcgttcttc

SEQ ID NO: 1970 - DNA, 36 bp, Artificial Sequence
  Description of Artificial Sequence: Synthetic oligonucleotide
tgtggaacatgggataggaggctgcttgctgttttc

SEQ ID NO: 1971 - DNA, 39 bp, Artificial Sequence
  Description of Artificial Sequence: Synthetic oligonucleotide
tgcggaacttgggataggaacctgcgcgccgtggtcttc

SEQ ID NO: 1972 - DNA, 36 bp, Artificial Sequence
  Description of Artificial Sequence: Synthetic oligonucleotide
tgcggaacatgggataggctgagtgctggggtgttc

SEQ ID NO: 1973 - DNA, 39 bp, Artificial Sequence
  Description of Artificial Sequence: Synthetic oligonucleotide
tgcggaacatgggatagaggcccgaatactggggtattc

SEQ ID NO: 1974 - DNA, 42 bp, Artificial Sequence
  Description of Artificial Sequence: Synthetic oligonucleotide
tgcggaacatgggatagaggcctgaatactgtttacgtcttc

SEQ ID NO: 1975 - DNA, 42 bp, Artificial Sequence
  Description of Artificial Sequence: Synthetic oligonucleotide
tgcggaacatgggataactatgtgagtgccccttgggtgttc

SEQ ID NO: 1976 - DNA, 45 bp, Artificial Sequence
  Description of Artificial Sequence: Synthetic oligonucleotide
tgcggaacatgggataactacctgagtgctggcgatgtggttttc

SEQ ID NO: 1977 - DNA, 39 bp, Artificial Sequence
  Description of Artificial Sequence: Synthetic oligonucleotide
tgcggaacatgggataactacctgagagctggggtcttc

SEQ ID NO: 1978 - DNA, 39 bp, Artificial Sequence
  Description of Artificial Sequence: Synthetic oligonucleotide
tgcggaacatgggacaattatctgggtgccgtggttttc

SEQ ID NO: 1979 - DNA, 39 bp, Artificial Sequence
  Description of Artificial Sequence: Synthetic oligonucleotide
tgcggaacatgggataactacctgggtgcgggggtgttc

SEQ ID NO: 1980 - DNA, 42 bp, Artificial Sequence
  Description of Artificial Sequence: Synthetic oligonucleotide
tgcggaacatgggataacaccgtgagtgccccttgggttttc

SEQ ID NO: 1981 - DNA, 39 bp, Artificial Sequence
  Description of Artificial Sequence: Synthetic oligonucleotide
tgcggaacatgggataacaccctgagtctttgggtgttc

SEQ ID NO: 1982 - DNA, 39 bp, Artificial Sequence
  Description of Artificial Sequence: Synthetic oligonucleotide
tgcggaacatgggataacaccctgagtgctggggtcttc

SEQ ID NO: 1983 - DNA, 39 bp, Artificial Sequence
  Description of Artificial Sequence: Synthetic oligonucleotide
tgcggaacatgggacaacactctgcttactgtgttattc

SEQ ID NO: 1984 - DNA, 39 bp, Artificial Sequence
  Description of Artificial Sequence: Synthetic oligonucleotide
tgcggaacatgggataacagactgagtagtgtgattttc

SEQ ID NO: 1985 - DNA, 39 bp, Artificial Sequence
  Description of Artificial Sequence: Synthetic oligonucleotide
tgcggaacatgggataacaggttgagtgctgtggtcttc

SEQ ID NO: 1986 - DNA, 42 bp, Artificial Sequence
  Description of Artificial Sequence: Synthetic oligonucleotide
tgcggaacatgggataacaggctgagtgctggtgggatattc

SEQ ID NO: 1987 - DNA, 39 bp, Artificial Sequence
  Description of Artificial Sequence: Synthetic oligonucleotide
tgcggaacatgggataacagactgagtgctgaggtgttc

SEQ ID NO: 1988 - DNA, 39 bp, Artificial Sequence
  Description of Artificial Sequence: Synthetic oligonucleotide
tgtggaacatgggataacagactgcgtgttggggttctc

SEQ ID NO: 1989 - DNA, 39 bp, Artificial Sequence
  Description of Artificial Sequence: Synthetic oligonucleotide
tgcggaacatgggataatcgcctgcttgagaatgtcttc

SEQ ID NO: 1990 - DNA, 36 bp, Artificial Sequence
  Description of Artificial Sequence: Synthetic oligonucleotide
tgcggaacatgggataacaacctgcgtgctgtcttc

SEQ ID NO: 1991 - DNA, 39 bp, Artificial Sequence
  Description of Artificial Sequence: Synthetic oligonucleotide
tgcggaacttgggataataacctgcgtgctggagtgttc

SEQ ID NO: 1992 - DNA, 42 bp, Artificial Sequence
  Description of Artificial Sequence: Synthetic oligonucleotide
tgcggaacatgggacaacaatttgggcggtggccgggtgttc

SEQ ID NO: 1993 - DNA, 39 bp, Artificial Sequence
  Description of Artificial Sequence: Synthetic oligonucleotide
tgcggaacatgggataacaacctgggtgctggcgtcctc

SEQ ID NO: 1994 - DNA, 39 bp, Artificial Sequence
  Description of Artificial Sequence: Synthetic oligonucleotide
tgcggaacatgggataacaacctgggtgctggcgtcttc

SEQ ID NO: 1995 - DNA, 39 bp, Artificial Sequence
  Description of Artificial Sequence: Synthetic oligonucleotide
tgcggaacttgggataacatcctgagcgctgcggtgttc

SEQ ID NO: 1996 - DNA, 39 bp, Artificial Sequence
  Description of Artificial Sequence: Synthetic oligonucleotide
tgcggaacctgggataacatcttggatgcaggggttttc

SEQ ID NO: 1997 - DNA, 39 bp, Artificial Sequence
  Description of Artificial Sequence: Synthetic oligonucleotide
tgcggaacatgggataacgacctgagtggttggctgttc

SEQ ID NO: 1998 - DNA, 39 bp, Artificial Sequence
  Description of Artificial Sequence: Synthetic oligonucleotide
tgcggaacatgggataacgacctgagtgcctgggtgttc

SEQ ID NO: 1999 - DNA, 39 bp, Artificial Sequence
  Description of Artificial Sequence: Synthetic oligonucleotide
tgcggaacatgggatctcaccctgggtggtgtggtgttc

SEQ ID NO: 2000 - DNA, 39 bp, Artificial Sequence
  Description of Artificial Sequence: Synthetic oligonucleotide
tgcggaacatgggatctcagcctgagtgctggggtattc

SEQ ID NO: 2001 - DNA, 39 bp, Artificial Sequence
  Description of Artificial Sequence: Synthetic oligonucleotide
tgcggaacatgggatctcagcctgaaagaatgggtgttc

SEQ ID NO: 2002 - DNA, 39 bp, Artificial Sequence
  Description of Artificial Sequence: Synthetic oligonucleotide
tgcggaacgtgggatctcagcctggatgctgttgttttc

SEQ ID NO: 2003 - DNA, 27 bp, Artificial Sequence
  Description of Artificial Sequence: Synthetic oligonucleotide
tgcggaacctgggacctgaaggttttc

SEQ ID NO: 2004 - DNA, 39 bp, Artificial Sequence
  Description of Artificial Sequence: Synthetic oligonucleotide
tgcggaacatgggataagactctgagtgtttgggtgttc

SEQ ID NO: 2005 - DNA, 39 bp, Artificial Sequence
  Description of Artificial Sequence: Synthetic oligonucleotide
tgcggaacatgggataagagcctgagtgtttgggtgttc

SEQ ID NO: 2006 - DNA, 39 bp, Artificial Sequence
  Description of Artificial Sequence: Synthetic oligonucleotide
tgcggaacatgggataagagcctgagtggtgtggtattt

SEQ ID NO: 2007 - DNA, 39 bp, Artificial Sequence
  Description of Artificial Sequence: Synthetic oligonucleotide
tgcggaacatgggataagagcctgagtgattgggtgttc

SEQ ID NO: 2008 - DNA, 39 bp, Artificial Sequence
  Description of Artificial Sequence: Synthetic oligonucleotide
tgcggaacatgggataagagcctgagtgctttggttttc

SEQ ID NO: 2009 - DNA, 39 bp, Artificial Sequence
  Description of Artificial Sequence: Synthetic oligonucleotide
tgcggaacatgggataagagcctgagtgctggcgtcttc

SEQ ID NO: 2010 - DNA, 39 bp, Artificial Sequence
  Description of Artificial Sequence: Synthetic oligonucleotide
tgcggaacatgggataagagcctgagtgccgacgtcttc

SEQ ID NO: 2011 - DNA, 39 bp, Artificial Sequence
  Description of Artificial Sequence: Synthetic oligonucleotide
tgcggaacatgggataaacgcctgactattgtggtcttc

SEQ ID NO: 2012 - DNA, 39 bp, Artificial Sequence
  Description of Artificial Sequence: Synthetic oligonucleotide
tgcggaacatgggataaacgcctgagtgcctgggtgctc

SEQ ID NO: 2013 - DNA, 39 bp, Artificial Sequence
  Description of Artificial Sequence: Synthetic oligonucleotide
tgcggaacatgggataagaacctgcgtgctgtggtcttc

SEQ ID NO: 2014 - DNA, 39 bp, Artificial Sequence
  Description of Artificial Sequence: Synthetic oligonucleotide
tgcggaacatgggatatcaccctgagtgggtttgtcttc

SEQ ID NO: 2015 - DNA, 39 bp, Artificial Sequence
  Description of Artificial Sequence: Synthetic oligonucleotide
tgcggaacatgggatatcaccttgcatactggagtattc

SEQ ID NO: 2016 - DNA, 36 bp, Artificial Sequence
  Description of Artificial Sequence: Synthetic oligonucleotide
tgcggaacatgggatatcagtgtgactgtggtgttc

SEQ ID NO: 2017 - DNA, 39 bp, Artificial Sequence
  Description of Artificial Sequence: Synthetic oligonucleotide
tgcggaacatgggatatcagtgtgaggggttatgccttc

SEQ ID NO: 2018 - DNA, 33 bp, Artificial Sequence
  Description of Artificial Sequence: Synthetic oligonucleotide
tgcggaacatgggatatcagccgttgggttttc

SEQ ID NO: 2019 - DNA, 39 bp, Artificial Sequence
  Description of Artificial Sequence: Synthetic oligonucleotide
tgcggaacatgggatatcagcccgagtgcttgggtgttc

SEQ ID NO: 2020 - DNA, 39 bp, Artificial Sequence
  Description of Artificial Sequence: Synthetic oligonucleotide
tgcggaacatgggatattagcctgagtgtctgggtgttc

SEQ ID NO: 2021 - DNA, 36 bp, Artificial Sequence
  Description of Artificial Sequence: Synthetic oligonucleotide
tgcggaacatgggatatcagcctgagtgttgtattc

SEQ ID NO: 2022 - DNA, 39 bp, Artificial Sequence
  Description of Artificial Sequence: Synthetic oligonucleotide
tgcggaacttgggatatcagcctgagttctgtggtgttc

SEQ ID NO: 2023 - DNA, 39 bp, Artificial Sequence
  Description of Artificial Sequence: Synthetic oligonucleotide
tgcggaacatgggatatcagcctgagtcactggttgttc

SEQ ID NO: 2024 - DNA, 39 bp, Artificial Sequence
  Description of Artificial Sequence: Synthetic oligonucleotide
tgcggaacatgggatatcagtctgagtggttgggtgttc

SEQ ID NO: 2025 - DNA, 39 bp, Artificial Sequence
  Description of Artificial Sequence: Synthetic oligonucleotide
tgcggaacatgggatatcagcctgagtggtcgagtgttc

SEQ ID NO: 2026 - DNA, 39 bp, Artificial Sequence
  Description of Artificial Sequence: Synthetic oligonucleotide
tgcggaacatgggacatcagcctgagtgcttgggcgttc

SEQ ID NO: 2027 - DNA, 39 bp, Artificial Sequence
  Description of Artificial Sequence: Synthetic oligonucleotide
tgcggaacatgggatatcagcctgagtgctgtggttttc

SEQ ID NO: 2028 - DNA, 39 bp, Artificial Sequence
  Description of Artificial Sequence: Synthetic oligonucleotide
tgcgggacatgggacatcagcctgagtgctgtgatattc

SEQ ID NO: 2029 - DNA, 36 bp, Artificial Sequence
  Description of Artificial Sequence: Synthetic oligonucleotide
tgcggaacatgggatatcagcctgagtgctgtgttc

SEQ ID NO: 2030 - DNA, 39 bp, Artificial Sequence
  Description of Artificial Sequence: Synthetic oligonucleotide
tgcggaacatgggatatcagcctgagtgcccgggtgttc

SEQ ID NO: 2031 - DNA, 39 bp, Artificial Sequence
  Description of Artificial Sequence: Synthetic oligonucleotide
tgcggaacatgggatatcagcctgagtgccctggtgttc

SEQ ID NO: 2032 - DNA, 39 bp, Artificial Sequence
  Description of Artificial Sequence: Synthetic oligonucleotide
tgcggaacatgggatattagcctgagtgcccatgtcttc

SEQ ID NO: 2033 - DNA, 42 bp, Artificial Sequence
  Description of Artificial Sequence: Synthetic oligonucleotide
tgcggaacatgggatatcagcctgagtgctggggtggtattc

SEQ ID NO: 2034 - DNA, 45 bp, Artificial Sequence
  Description of Artificial Sequence: Synthetic oligonucleotide
tgcggaacatgggatatcagcctgagtgccggcccttatgtcttc

SEQ ID NO: 2035 - DNA, 42 bp, Artificial Sequence
  Description of Artificial Sequence: Synthetic oligonucleotide
tgcggcacatgggatatcagcctgagtgctggaggggtgttc

SEQ ID NO: 2036 - DNA, 39 bp, Artificial Sequence
  Description of Artificial Sequence: Synthetic oligonucleotide
tgcggaacatgggatatcagcctgagtgctgaggttttc

SEQ ID NO: 2037 - DNA, 39 bp, Artificial Sequence
  Description of Artificial Sequence: Synthetic oligonucleotide
tgcggaacatgggatatcagcctgagtgctgctgtgttc

SEQ ID NO: 2038 - DNA, 36 bp, Artificial Sequence
  Description of Artificial Sequence: Synthetic oligonucleotide
tgcggaacatgggatatcagcctgcgtgctgtgttc

SEQ ID NO: 2039 - DNA, 39 bp, Artificial Sequence
  Description of Artificial Sequence: Synthetic oligonucleotide
tgcggaacatgggatattagcctgaatactggggtgttc

SEQ ID NO: 2040 - DNA, 39 bp, Artificial Sequence
  Description of Artificial Sequence: Synthetic oligonucleotide
tgcggaacatgggatatcagcctaaataattatgtcttc

SEQ ID NO: 2041 - DNA, 39 bp, Artificial Sequence
  Description of Artificial Sequence: Synthetic oligonucleotide
tgcggaacatgggatatcagcctaattgctggggtattc

SEQ ID NO: 2042 - DNA, 39 bp, Artificial Sequence
  Description of Artificial Sequence: Synthetic oligonucleotide
tgcggaacatgggatatcagcctgcatacttggctgttc

SEQ ID NO: 2043 - DNA, 42 bp, Artificial Sequence
  Description of Artificial Sequence: Synthetic oligonucleotide
tgcggaacatgggatatccgcctgaccgatgagctgttattc

SEQ ID NO: 2044 - DNA, 39 bp, Artificial Sequence
  Description of Artificial Sequence: Synthetic oligonucleotide
tgcggaacatgggatatcagactgagcggttttgttttc

SEQ ID NO: 2045 - DNA, 48 bp, Artificial Sequence
  Description of Artificial Sequence: Synthetic oligonucleotide
tgcggaacatgggatatcaacctgggtgctgggggcctttatgtcttc

SEQ ID NO: 2046 - DNA, 39 bp, Artificial Sequence
  Description of Artificial Sequence: Synthetic oligonucleotide
tgcggaacatgggatatcatcctgagtgctgaggtattc

SEQ ID NO: 2047 - DNA, 36 bp, Artificial Sequence
  Description of Artificial Sequence: Synthetic oligonucleotide
tgcggaacatgggatcacaccctgagtgctgtcttc

SEQ ID NO: 2048 - DNA, 39 bp, Artificial Sequence
  Description of Artificial Sequence: Synthetic oligonucleotide
tgcggaacatgggaccacactctgcttactgtgttattc

SEQ ID NO: 2049 - DNA, 39 bp, Artificial Sequence
  Description of Artificial Sequence: Synthetic oligonucleotide
tgcggaacatgggatcacagcctgactgctgtggtattc

SEQ ID NO: 2050 - DNA, 39 bp, Artificial Sequence
  Description of Artificial Sequence: Synthetic oligonucleotide
tgcggaacctgggatcacagcctgactgctgggatattc

SEQ ID NO: 2051 - DNA, 39 bp, Artificial Sequence
  Description of Artificial Sequence: Synthetic oligonucleotide
tgcggaacatgggatcacagcctgagtgttgtattattc

SEQ ID NO: 2052 - DNA, 36 bp, Artificial Sequence
  Description of Artificial Sequence: Synthetic oligonucleotide
tgcggaacatgggatcacagcctgagtttggtattc

SEQ ID NO: 2053 - DNA, 39 bp, Artificial Sequence
  Description of Artificial Sequence: Synthetic oligonucleotide
tgcggaacatgggatcacagcctgtctattggggttttc

SEQ ID NO: 2054 - DNA, 39 bp, Artificial Sequence
  Description of Artificial Sequence: Synthetic oligonucleotide
tgcggaacatgggatcacagcctgagtgctggggtgttc

SEQ ID NO: 2055 - DNA, 39 bp, Artificial Sequence
  Description of Artificial Sequence: Synthetic oligonucleotide
tgtggaacttgggatcacagcctgagtgctttcgtgttc

SEQ ID NO: 2056 - DNA, 39 bp, Artificial Sequence
  Description of Artificial Sequence: Synthetic oligonucleotide
tgcggaacatgggatcacagtctgagtgctgctgttttc

SEQ ID NO: 2057 - DNA, 36 bp, Artificial Sequence
  Description of Artificial Sequence: Synthetic oligonucleotide
tgcggaacatgggaccacaatctgcgtgctgtcttc

SEQ ID NO: 2058 - DNA, 39 bp, Artificial Sequence
  Description of Artificial Sequence: Synthetic oligonucleotide
tgcgggacatgggatttcaccctgagtgttgggcgcttc

SEQ ID NO: 2059 - DNA, 39 bp, Artificial Sequence
  Description of Artificial Sequence: Synthetic oligonucleotide
tgcggaacatgggatttcaccctgagtgctcctgtcttc

SEQ ID NO: 2060 - DNA, 42 bp, Artificial Sequence
  Description of Artificial Sequence: Synthetic oligonucleotide
tgcggaacgtgggatttcagcgtgagtgctgggtgggtgttc

SEQ ID NO: 2061 - DNA, 39 bp, Artificial Sequence
  Description of Artificial Sequence: Synthetic oligonucleotide
tgcggaacgtgggatttcagtcttactacctggttattc

SEQ ID NO: 2062 - DNA, 39 bp, Artificial Sequence
  Description of Artificial Sequence: Synthetic oligonucleotide
tgcggaacatgggatttcagcctgagtgtttgggtgttc

SEQ ID NO: 2063 - DNA, 39 bp, Artificial Sequence
  Description of Artificial Sequence: Synthetic oligonucleotide
tgcggaacatgggatttcagcctgagtactggggttttc

SEQ ID NO: 2064 - DNA, 39 bp, Artificial Sequence
  Description of Artificial Sequence: Synthetic oligonucleotide
tgcggcacatgggatttcagcctgagtggtgtggtattc

SEQ ID NO: 2065 - DNA, 39 bp, Artificial Sequence
  Description of Artificial Sequence: Synthetic oligonucleotide
tgcggaacatgggatttcagcctgagtggtttcgtgttc

SEQ ID NO: 2066 - DNA, 39 bp, Artificial Sequence
  Description of Artificial Sequence: Synthetic oligonucleotide
tgcggaacatgggatttcagcctgagtgctggggtgttc

SEQ ID NO: 2067 - DNA, 39 bp, Artificial Sequence
  Description of Artificial Sequence: Synthetic oligonucleotide
tgcggaacatgggatgaaaccgtgagaggttgggtgttc

SEQ ID NO: 2068 - DNA, 39 bp, Artificial Sequence
  Description of Artificial Sequence: Synthetic oligonucleotide
tgcggaacatgggatgaaagtctgagaagctgggtgttc

SEQ ID NO: 2069 - DNA, 45 bp, Artificial Sequence
  Description of Artificial Sequence: Synthetic oligonucleotide
tgcggaacttgggatgagaggcagactgatgagtcctatgtcttc

SEQ ID NO: 2070 - DNA, 42 bp, Artificial Sequence
  Description of Artificial Sequence: Synthetic oligonucleotide
tgcggaacatgggatgagagactcgttgctggccaggtcttc

SEQ ID NO: 2071 - DNA, 42 bp, Artificial Sequence
  Description of Artificial Sequence: Synthetic oligonucleotide
tgcggaacatgggatgagagactgagtcctggagcttttttc

SEQ ID NO: 2072 - DNA, 27 bp, Artificial Sequence
  Description of Artificial Sequence: Synthetic oligonucleotide
tgcggaacatgggatgagaaggtgttc

SEQ ID NO: 2073 - DNA, 45 bp, Artificial Sequence
  Description of Artificial Sequence: Synthetic oligonucleotide
tgcggaacctgggatgaaggccagactactgatttctttgtcttc

SEQ ID NO: 2074 - DNA, 39 bp, Artificial Sequence
  Description of Artificial Sequence: Synthetic oligonucleotide
tgcggaacatgggatgacaccctggctggtgtggtcttc

SEQ ID NO: 2075 - DNA, 39 bp, Artificial Sequence
  Description of Artificial Sequence: Synthetic oligonucleotide
tgcggaacatgggatgacaggctgacttctgcggtcttc

SEQ ID NO: 2076 - DNA, 39 bp, Artificial Sequence
  Description of Artificial Sequence: Synthetic oligonucleotide
tgcggaacatgggatgacagactgtttgttgtggtattc

SEQ ID NO: 2077 - DNA, 39 bp, Artificial Sequence
  Description of Artificial Sequence: Synthetic oligonucleotide
tgcggaacatgggatgataacctgagaggttgggtgttc

SEQ ID NO: 2078 - DNA, 39 bp, Artificial Sequence
  Description of Artificial Sequence: Synthetic oligonucleotide
tgcggaacatgggatgacaacctgcgtggtgtcgtgttc

SEQ ID NO: 2079 - DNA, 42 bp, Artificial Sequence
  Description of Artificial Sequence: Synthetic oligonucleotide
tgcggaacctgggatgacaatttgaatattggaagggtgttc

SEQ ID NO: 2080 - DNA, 39 bp, Artificial Sequence
  Description of Artificial Sequence: Synthetic oligonucleotide
tgcggaacatgggatgacatcctgagtgctgtgatattc

SEQ ID NO: 2081 - DNA, 39 bp, Artificial Sequence
  Description of Artificial Sequence: Synthetic oligonucleotide
tgcggaacatgggatgatatcctgagaggttgggtgttc

SEQ ID NO: 2082 - DNA, 42 bp, Artificial Sequence
  Description of Artificial Sequence: Synthetic oligonucleotide
tgcggaacatgggatgccaccctgagtcctgggtggttattc

SEQ ID NO: 2083 - DNA, 39 bp, Artificial Sequence
  Description of Artificial Sequence: Synthetic oligonucleotide
tgcggaacatgggatgccagcgtgacttcttgggtgttc

SEQ ID NO: 2084 - DNA, 39 bp, Artificial Sequence
  Description of Artificial Sequence: Synthetic oligonucleotide
tgcggaacatgggatgccagcctgacttctgtggtcttc

SEQ ID NO: 2085 - DNA, 39 bp, Artificial Sequence
  Description of Artificial Sequence: Synthetic oligonucleotide
tgcggaacatgggatgccagcctgagtgtttgggtgttc

SEQ ID NO: 2086 - DNA, 42 bp, Artificial Sequence
  Description of Artificial Sequence: Synthetic oligonucleotide
tgcggaacatgggatgccagcctgagtgttccttgggtgttc

SEQ ID NO: 2087 - DNA, 39 bp, Artificial Sequence
  Description of Artificial Sequence: Synthetic oligonucleotide
tgcggaacatgggatgccagcctgagtgtggcggtattc

SEQ ID NO: 2088 - DNA, 39 bp, Artificial Sequence
  Description of Artificial Sequence: Synthetic oligonucleotide
tgcggaacatgggatgccagcctgagtacctgggtattc

SEQ ID NO: 2089 - DNA, 39 bp, Artificial Sequence
  Description of Artificial Sequence: Synthetic oligonucleotide
tgcggaacatgggatgccagcctgagtggtgtggtattc

SEQ ID NO: 2090 - DNA, 42 bp, Artificial Sequence
  Description of Artificial Sequence: Synthetic oligonucleotide
tgcggaacatgggatgccagcctgagtggtgggggagaattc

SEQ ID NO: 2091 - DNA, 39 bp, Artificial Sequence
  Description of Artificial Sequence: Synthetic oligonucleotide
tgcggaacatgggatgccagcctgagtgctggggtgttc

SEQ ID NO: 2092 - DNA, 39 bp, Artificial Sequence
  Description of Artificial Sequence: Synthetic oligonucleotide
tgcggaacatgggatgccagcctgagtgctgggcttttc

SEQ ID NO: 2093 - DNA, 39 bp, Artificial Sequence
  Description of Artificial Sequence: Synthetic oligonucleotide
tgtggcacatgggatgccagcctgagtgctgaagtcttc

SEQ ID NO: 2094 - DNA, 45 bp, Artificial Sequence
  Description of Artificial Sequence: Synthetic oligonucleotide
tgcggaacatgggatgccagcctgagtgctgacttttgggtgttc

SEQ ID NO: 2095 - DNA, 36 bp, Artificial Sequence
  Description of Artificial Sequence: Synthetic oligonucleotide
tgcggaacatgggatgccagcctgagagtcttcttc

SEQ ID NO: 2096 - DNA, 39 bp, Artificial Sequence
  Description of Artificial Sequence: Synthetic oligonucleotide
tgcggaacatgggatgccagtctgagggctgtggtactc

SEQ ID NO: 2097 - DNA, 39 bp, Artificial Sequence
  Description of Artificial Sequence: Synthetic oligonucleotide
tgcggaacatgggatgccagcctgaatatttgggttttc

SEQ ID NO: 2098 - DNA, 39 bp, Artificial Sequence
  Description of Artificial Sequence: Synthetic oligonucleotide
tgcgggacatgggatgccagcctgaagaatctggtcttc

SEQ ID NO: 2099 - DNA, 39 bp, Artificial Sequence
  Description of Artificial Sequence: Synthetic oligonucleotide
tgcggaacatgggatgccagcctgggtgcctgggtattc

SEQ ID NO: 2100 - DNA, 39 bp, Artificial Sequence
  Description of Artificial Sequence: Synthetic oligonucleotide
tgcggaacatgggatgccagcctgggtgctgtggtcttc

SEQ ID NO: 2101 - DNA, 39 bp, Artificial Sequence
  Description of Artificial Sequence: Synthetic oligonucleotide
tgcggaacatgggatgccagcctgggtgcgggggtcttc

SEQ ID NO: 2102 - DNA, 42 bp, Artificial Sequence
  Description of Artificial Sequence: Synthetic oligonucleotide
tgcggaacatgggatgctaggctgagtggcctttatgtcttc

SEQ ID NO: 2103 - DNA, 39 bp, Artificial Sequence
  Description of Artificial Sequence: Synthetic oligonucleotide
tgtggaacctgggatgcgagactgggtggtgcagtcttc

SEQ ID NO: 2104 - DNA, 39 bp, Artificial Sequence
  Description of Artificial Sequence: Synthetic oligonucleotide
tgcggaacatgggatgccaatctgcgtgctggggtcttc

SEQ ID NO: 2105 - DNA, 39 bp, Artificial Sequence
  Description of Artificial Sequence: Synthetic oligonucleotide
tgcggaacatgggatgctatcataagtggttgggtgttc

SEQ ID NO: 2106 - DNA, 39 bp, Artificial Sequence
  Description of Artificial Sequence: Synthetic oligonucleotide
tgcggaacatgggatgccggccagagtgtttgggtgttc

SEQ ID NO: 2107 - DNA, 42 bp, Artificial Sequence
  Description of Artificial Sequence: Synthetic oligonucleotide
tgcggcacatgggatgccgggctgactggcctttatgtcttc

SEQ ID NO: 2108 - DNA, 39 bp, Artificial Sequence
  Description of Artificial Sequence: Synthetic oligonucleotide
tgcggaacttgggatgccggtctgagtgtttatgtcttc

SEQ ID NO: 2109 - DNA, 39 bp, Artificial Sequence
  Description of Artificial Sequence: Synthetic oligonucleotide
tgcgggacatgggatgccggcctgagtactggggtcttc

SEQ ID NO: 2110 - DNA, 39 bp, Artificial Sequence
  Description of Artificial Sequence: Synthetic oligonucleotide
tgcggaacatgggatgccggcctgagtggggacgttttc

SEQ ID NO: 2111 - DNA, 42 bp, Artificial Sequence
  Description of Artificial Sequence: Synthetic oligonucleotide
tgcggaacatgggatgccggcctgagtgctggttatgtcttc

SEQ ID NO: 2112 - DNA, 39 bp, Artificial Sequence
  Description of Artificial Sequence: Synthetic oligonucleotide
tgcggaacatgggatgccggcctgcgtgtttgggtgttc

SEQ ID NO: 2113 - DNA, 36 bp, Artificial Sequence
  Description of Artificial Sequence: Synthetic oligonucleotide
tgcggaacatgggatgccggcctgagggaaattttc

SEQ ID NO: 2114 - DNA, 39 bp, Artificial Sequence
  Description of Artificial Sequence: Synthetic oligonucleotide
tgcggaacatgggccagcagcctgagttcttgggtgttc

SEQ ID NO: 2115 - DNA, 39 bp, Artificial Sequence
  Description of Artificial Sequence: Synthetic oligonucleotide
tgcggaacatgggctggcagcctgagtggtcatgtcttc

SEQ ID NO: 2116 - DNA, 42 bp, Artificial Sequence
  Description of Artificial Sequence: Synthetic oligonucleotide
tgcggaacatgggctggcagcctgagtgccgcttgggtgttc

SEQ ID NO: 2117 - DNA, 42 bp, Artificial Sequence
  Description of Artificial Sequence: Synthetic oligonucleotide
tgcggaacatgggctggcagcctgaatgtttattgggtgttc

SEQ ID NO: 2118 - DNA, 42 bp, Artificial Sequence
  Description of Artificial Sequence: Synthetic oligonucleotide
tgcggaacatgggctggcaacctgagacctaattgggtgttc

SEQ ID NO: 2119 - DNA, 36 bp, Artificial Sequence
  Description of Artificial Sequence: Synthetic oligonucleotide
tgcggaacaaggggtagcctgggtggtgcggtgttc

SEQ ID NO: 2120 - DNA, 39 bp, Artificial Sequence
  Description of Artificial Sequence: Synthetic oligonucleotide
tgcggaacaagggataccaccctgagtgtcccggtgttc

SEQ ID NO: 2121 - DNA, 39 bp, Artificial Sequence
  Description of Artificial Sequence: Synthetic oligonucleotide
tgcggaacacgggataccagcctcaatattgaaatcttc

SEQ ID NO: 2122 - DNA, 36 bp, Artificial Sequence
  Description of Artificial Sequence: Synthetic oligonucleotide
tgtggaacacgggataccagcctgaatgatgtcttc

SEQ ID NO: 2123 - DNA, 39 bp, Artificial Sequence
  Description of Artificial Sequence: Synthetic oligonucleotide
tgcggaacacgggatacccgcctgagtattgtggttttc

SEQ ID NO: 2124 - DNA, 39 bp, Artificial Sequence
  Description of Artificial Sequence: Synthetic oligonucleotide
tgcggcacacgggataccatcctgagtgctgaggtgttc

SEQ ID NO: 2125 - DNA, 39 bp, Artificial Sequence
  Description of Artificial Sequence: Synthetic oligonucleotide
tgcggaacacgggatagaagcctgagtggttgggtgttc

SEQ ID NO: 2126 - DNA, 33 bp, Artificial Sequence
  Description of Artificial Sequence: Synthetic oligonucleotide
tgcggatcatggtattacaatgtcttccttttc

SEQ ID NO: 2127 - DNA, 39 bp, Artificial Sequence
  Description of Artificial Sequence: Synthetic oligonucleotide
tgcggatcttggcatagcagcctcaaccttgtcgtcttc

SEQ ID NO: 2128 - DNA, 42 bp, Artificial Sequence
  Description of Artificial Sequence: Synthetic oligonucleotide
tgcggatcatggggtagtggcctgagtgccccttatgtcttc

SEQ ID NO: 2129 - DNA, 39 bp, Artificial Sequence
  Description of Artificial Sequence: Synthetic oligonucleotide
tgcggttcgtgggaaagcggcctgggtgcttggctgttc

SEQ ID NO: 2130 - DNA, 33 bp, Artificial Sequence
  Description of Artificial Sequence: Synthetic oligonucleotide
tgcggatcctgggattacggcctcctactcttc

SEQ ID NO: 2131 - DNA, 36 bp, Artificial Sequence
  Description of Artificial Sequence: Synthetic oligonucleotide
tgcggttcatgggatgtcagcctgactgctgttttc

SEQ ID NO: 2132 - DNA, 39 bp, Artificial Sequence
  Description of Artificial Sequence: Synthetic oligonucleotide
tgcggatcctgggatgtcagtctcaatgttggcattttc

SEQ ID NO: 2133 - DNA, 39 bp, Artificial Sequence
  Description of Artificial Sequence: Synthetic oligonucleotide
tgcggatcatgggataccaccctgcgtgcttgggtgttc

SEQ ID NO: 2134 - DNA, 42 bp, Artificial Sequence
  Description of Artificial Sequence: Synthetic oligonucleotide
tgcggctcgtgggataccagccctgtccgtgcttgggtgttc

SEQ ID NO: 2135 - DNA, 39 bp, Artificial Sequence
  Description of Artificial Sequence: Synthetic oligonucleotide
tgcggatcatgggataccagcctgagtgtttgggtgttc

SEQ ID NO: 2136 - DNA, 39 bp, Artificial Sequence
  Description of Artificial Sequence: Synthetic oligonucleotide
tgcggatcatgggataccagcctgagtgctgaggtgttc

SEQ ID NO: 2137 - DNA, 39 bp, Artificial Sequence
  Description of Artificial Sequence: Synthetic oligonucleotide
tgcggctcgtgggataccagcctgcgtgcttgggtgttc

SEQ ID NO: 2138 - DNA, 39 bp, Artificial Sequence
  Description of Artificial Sequence: Synthetic oligonucleotide
tgcggctcgtgggataccagcctgcgtgcttgggcgttc

SEQ ID NO: 2139 - DNA, 39 bp, Artificial Sequence
  Description of Artificial Sequence: Synthetic oligonucleotide
tgcggatcatgggataccagcctggatgctaggctgttc

SEQ ID NO: 2140 - DNA, 39 bp, Artificial Sequence
  Description of Artificial Sequence: Synthetic oligonucleotide
tgcggatcatgggataccatcctgcttgtctatgtcttc

SEQ ID NO: 2141 - DNA, 36 bp, Artificial Sequence
  Description of Artificial Sequence: Synthetic oligonucleotide
tgcggatcatgggatcgctggcaggctgctgtcttc

SEQ ID NO: 2142 - DNA, 39 bp, Artificial Sequence
  Description of Artificial Sequence: Synthetic oligonucleotide
tgcggatcatgggataggagcctgagtgggtatgtcttc

SEQ ID NO: 2143 - DNA, 39 bp, Artificial Sequence
  Description of Artificial Sequence: Synthetic oligonucleotide
tgcggatcatgggatagaagcctgagtgcttatgtcttc

SEQ ID NO: 2144 - DNA, 39 bp, Artificial Sequence
  Description of Artificial Sequence: Synthetic oligonucleotide
tgcggatcatgggataggagcctgagtgccgtggttttc

SEQ ID NO: 2145 - DNA, 39 bp, Artificial Sequence
  Description of Artificial Sequence: Synthetic oligonucleotide
tgcggatcatgggataacaccttgggtgttgttctcttc

SEQ ID NO: 2146 - DNA, 39 bp, Artificial Sequence
  Description of Artificial Sequence: Synthetic oligonucleotide
tgcggatcgtgggataacagactaagtactgtcatcttc

SEQ ID NO: 2147 - DNA, 39 bp, Artificial Sequence
  Description of Artificial Sequence: Synthetic oligonucleotide
tgcggaagctgggataatcgattgaacactgtgattttc

SEQ ID NO: 2148 - DNA, 42 bp, Artificial Sequence
  Description of Artificial Sequence: Synthetic oligonucleotide
tgcggttcatgggatctcagccctgtacgtgtccttgtgttc

SEQ ID NO: 2149 - DNA, 39 bp, Artificial Sequence
  Description of Artificial Sequence: Synthetic oligonucleotide
tgcggatcatgggatctcagcctgagtgctgtcgttttc

SEQ ID NO: 2150 - DNA, 39 bp, Artificial Sequence
  Description of Artificial Sequence: Synthetic oligonucleotide
tgcggatcatgggataaaaacctgcgtgctgtgctgttc

SEQ ID NO: 2151 - DNA, 39 bp, Artificial Sequence
  Description of Artificial Sequence: Synthetic oligonucleotide
tgcggctcatgggatatcagcctgagtgctggggtgttc

SEQ ID NO: 2152 - DNA, 39 bp, Artificial Sequence
  Description of Artificial Sequence: Synthetic oligonucleotide
tgcggatcatgggatatcagactgagtgcagaggtcttc

SEQ ID NO: 2153 - DNA, 39 bp, Artificial Sequence
  Description of Artificial Sequence: Synthetic oligonucleotide
tgcggatcatgggacatcaaactgaatattggggtattc

SEQ ID NO: 2154 - DNA, 39 bp, Artificial Sequence
  Description of Artificial Sequence: Synthetic oligonucleotide
tgcggatcatgggatttcagtctcaattattttgtcttc

SEQ ID NO: 2155 - DNA, 39 bp, Artificial Sequence
  Description of Artificial Sequence: Synthetic oligonucleotide
tgcggatcatgggatgccagcctgagtactgaggtgttc

SEQ ID NO: 2156 - DNA, 39 bp, Artificial Sequence
  Description of Artificial Sequence: Synthetic oligonucleotide
tgcggatcctgggatgccggcctgcgtggctgggttttc

SEQ ID NO: 2157 - DNA, 39 bp, Artificial Sequence
  Description of Artificial Sequence: Synthetic oligonucleotide
tgcggaagatgggagagcagcctgggtgctgtggttttc

SEQ ID NO: 2158 - DNA, 39 bp, Artificial Sequence
  Description of Artificial Sequence: Synthetic oligonucleotide
tgcggaagatgggattttagtctgagtgcttatgtcttc

SEQ ID NO: 2159 - DNA, 39 bp, Artificial Sequence
  Description of Artificial Sequence: Synthetic oligonucleotide
tgcggacaatgggataacgacctgagtgtttgggtgttc

SEQ ID NO: 2160 - DNA, 42 bp, Artificial Sequence
  Description of Artificial Sequence: Synthetic oligonucleotide
tgcggaccctggcatagcagcgtgactagtggccacgtgctc

SEQ ID NO: 2161 - DNA, 45 bp, Artificial Sequence
  Description of Artificial Sequence: Synthetic oligonucleotide
tgcggattatgggatgccagcctgagtgctcctacttgggtgttc

SEQ ID NO: 2162 - DNA, 39 bp, Artificial Sequence
  Description of Artificial Sequence: Synthetic oligonucleotide
tgtggaatatggcacactagcctgagtgcttgggtgttc

SEQ ID NO: 2163 - DNA, 39 bp, Artificial Sequence
  Description of Artificial Sequence: Synthetic oligonucleotide
tgcggaatatgggattacagcctggatacttgggtgttc

SEQ ID NO: 2164 - DNA, 39 bp, Artificial Sequence
  Description of Artificial Sequence: Synthetic oligonucleotide
tgcggcatatgggataccagcctgagtgcttgggtgttc

SEQ ID NO: 2165 - DNA, 39 bp, Artificial Sequence
  Description of Artificial Sequence: Synthetic oligonucleotide
tgcggaatttgggataccaggctgagtgtttatgtcttc

SEQ ID NO: 2166 - DNA, 39 bp, Artificial Sequence
  Description of Artificial Sequence: Synthetic oligonucleotide
tgcggaatttgggataccaggctgagtgtttatatcttc

SEQ ID NO: 2167 - DNA, 36 bp, Artificial Sequence
  Description of Artificial Sequence: Synthetic oligonucleotide
tgtggaatatgggatacgaatctgggttatctcttc

SEQ ID NO: 2168 - DNA, 39 bp, Artificial Sequence
  Description of Artificial Sequence: Synthetic oligonucleotide
tgcggtatatgggataccggcctgagtgctgtggtattc

SEQ ID NO: 2169 - DNA, 39 bp, Artificial Sequence
  Description of Artificial Sequence: Synthetic oligonucleotide
tgcggaatatgggatcgcagcctgagtgcttgggtgttt

SEQ ID NO: 2170 - DNA, 39 bp, Artificial Sequence
  Description of Artificial Sequence: Synthetic oligonucleotide
tgcggaattcgggataccaggctgagtgtttatgtcttc

SEQ ID NO: 2171 - DNA, 42 bp, Artificial Sequence
  Description of Artificial Sequence: Synthetic oligonucleotide
tgcggaggatggagtagcagactgggtgttggcccagtgttt

SEQ ID NO: 2172 - DNA, 39 bp, Artificial Sequence
  Description of Artificial Sequence: Synthetic oligonucleotide
tgcggaggatggggtagcggcctgagtgcttgggtgttc

SEQ ID NO: 2173 - DNA, 39 bp, Artificial Sequence
  Description of Artificial Sequence: Synthetic oligonucleotide
tgcggaggatgggataccagcctgagtgcttgggtgttc

SEQ ID NO: 2174 - DNA, 39 bp, Artificial Sequence
  Description of Artificial Sequence: Synthetic oligonucleotide
tgcggaggatgggataggggcctggatgcttgggttttc

SEQ ID NO: 2175 - DNA, 33 bp, Artificial Sequence
  Description of Artificial Sequence: Synthetic oligonucleotide
tgcggagcatggcgtaataacgtgtgggtgttc

SEQ ID NO: 2176 - DNA, 48 bp, Artificial Sequence
  Description of Artificial Sequence: Synthetic oligonucleotide
tgcggagcatggaacaggcgcctgaatcctcattctcattgggtgttc

SEQ ID NO: 2177 - DNA, 36 bp, Artificial Sequence
  Description of Artificial Sequence: Synthetic oligonucleotide
tgcggagcctggcacaacaaactgagcgcggtcttc

SEQ ID NO: 2178 - DNA, 39 bp, Artificial Sequence
  Description of Artificial Sequence: Synthetic oligonucleotide
tgcggagcatggggtagcagcctgagagctagtgtcttc

SEQ ID NO: 2179 - DNA, 39 bp, Artificial Sequence
  Description of Artificial Sequence: Synthetic oligonucleotide
tgcggagcatggggtagcggcctgagtgcttgggtgttc

SEQ ID NO: 2180 - DNA, 42 bp, Artificial Sequence
  Description of Artificial Sequence: Synthetic oligonucleotide
tgcggagcatgggaaagtagcctgagtgccccttatgtcttc

SEQ ID NO: 2181 - DNA, 39 bp, Artificial Sequence
  Description of Artificial Sequence: Synthetic oligonucleotide
tgcggagcatgggagagcagcctcaatgttggactgatc

SEQ ID NO: 2182 - DNA, 42 bp, Artificial Sequence
  Description of Artificial Sequence: Synthetic oligonucleotide
tgcggagcatgggagagcggccggagtgctggggtggtgttc

SEQ ID NO: 2183 - DNA, 39 bp, Artificial Sequence
  Description of Artificial Sequence: Synthetic oligonucleotide
tgcggagcttgggattacagtgtgagtggttgggtgttc

SEQ ID NO: 2184 - DNA, 39 bp, Artificial Sequence
  Description of Artificial Sequence: Synthetic oligonucleotide
tgcggagcatgggattacagcctgactgccggagtattc

SEQ ID NO: 2185 - DNA, 39 bp, Artificial Sequence
  Description of Artificial Sequence: Synthetic oligonucleotide
tgcggagcctgggattacagactgagtgccgtgctattc

SEQ ID NO: 2186 - DNA, 39 bp, Artificial Sequence
  Description of Artificial Sequence: Synthetic oligonucleotide
tgcggagcgtgggatgttcgtctggatgttggggtgttc

SEQ ID NO: 2187 - DNA, 33 bp, Artificial Sequence
  Description of Artificial Sequence: Synthetic oligonucleotide
tgcggagcatgggatacctacagttatgtcttc

SEQ ID NO: 2188 - DNA, 39 bp, Artificial Sequence
  Description of Artificial Sequence: Synthetic oligonucleotide
tgcggagcatgggatacgaccctgagtggtgtggtattc

SEQ ID NO: 2189 - DNA, 39 bp, Artificial Sequence
  Description of Artificial Sequence: Synthetic oligonucleotide
tgcggagcgtgggatactaccctgagtgctgtgatattc

SEQ ID NO: 2190 - DNA, 42 bp, Artificial Sequence
  Description of Artificial Sequence: Synthetic oligonucleotide
tgcggcgcatgggataccagccagggtgcgtcttatgtcttt

SEQ ID NO: 2191 - DNA, 42 bp, Artificial Sequence
  Description of Artificial Sequence: Synthetic oligonucleotide
tgcggagcatgggataccagccctgtacgtgctggggtgttc

SEQ ID NO: 2192 - DNA, 33 bp, Artificial Sequence
  Description of Artificial Sequence: Synthetic oligonucleotide
tgcggagcatgggataccagcctgtggcttttc

SEQ ID NO: 2193 - DNA, 39 bp, Artificial Sequence
  Description of Artificial Sequence: Synthetic oligonucleotide
tgcggagcatgggataccagcctgactgtttatgtcttc

SEQ ID NO: 2194 - DNA, 39 bp, Artificial Sequence
  Description of Artificial Sequence: Synthetic oligonucleotide
tgcggagcatgggacaccagtctgactgctggggtgttc

SEQ ID NO: 2195 - DNA, 39 bp, Artificial Sequence
  Description of Artificial Sequence: Synthetic oligonucleotide
tgcggagcttgggataccagcctgagtactgtggttttc

SEQ ID NO: 2196 - DNA, 42 bp, Artificial Sequence
  Description of Artificial Sequence: Synthetic oligonucleotide
tgcggagcatgggataccagcctgagttctagatacatattc

SEQ ID NO: 2197 - DNA, 39 bp, Artificial Sequence
  Description of Artificial Sequence: Synthetic oligonucleotide
tgcggagcatgggataccagcctgagtggttatgtcttc

SEQ ID NO: 2198 - DNA, 39 bp, Artificial Sequence
  Description of Artificial Sequence: Synthetic oligonucleotide
tgcggagcctgggataccagcctgagtggctgggtgttc

SEQ ID NO: 2199 - DNA, 39 bp, Artificial Sequence
  Description of Artificial Sequence: Synthetic oligonucleotide
tgcggagcatgggataccagtctgagtggtgtgctattc

SEQ ID NO: 2200 - DNA, 39 bp, Artificial Sequence
  Description of Artificial Sequence: Synthetic oligonucleotide
tgcggagcttgggataccagcttgagtggtcttgttttc

SEQ ID NO: 2201 - DNA, 39 bp, Artificial Sequence
  Description of Artificial Sequence: Synthetic oligonucleotide
tgcggagcttgggataccagcttgagtggttttgttttc

SEQ ID NO: 2202 - DNA, 39 bp, Artificial Sequence
  Description of Artificial Sequence: Synthetic oligonucleotide
tgcggagcatgggataccagcctgagtggtgaggtcttt

SEQ ID NO: 2203 - DNA, 39 bp, Artificial Sequence
  Description of Artificial Sequence: Synthetic oligonucleotide
tgcggagcttgggataccagcttgagtgattttgttttc

SEQ ID NO: 2204 - DNA, 39 bp, Artificial Sequence
  Description of Artificial Sequence: Synthetic oligonucleotide
tgcggagcatgggataccagcctgcgaactgcgatattc

SEQ ID NO: 2205 - DNA, 33 bp, Artificial Sequence
  Description of Artificial Sequence: Synthetic oligonucleotide
tgcggagcatgggataccagcctgcggcttttc

SEQ ID NO: 2206 - DNA, 39 bp, Artificial Sequence
  Description of Artificial Sequence: Synthetic oligonucleotide
tgcggagcatgggataccagcctgaatgttcatgtcttc

SEQ ID NO: 2207 - DNA, 39 bp, Artificial Sequence
  Description of Artificial Sequence: Synthetic oligonucleotide
tgcggagcatgggataccagcctcaataaatgggtgttc

SEQ ID NO: 2208 - DNA, 39 bp, Artificial Sequence
  Description of Artificial Sequence: Synthetic oligonucleotide
tgcggagcatgggatacccgcctcagtgcgcggctgttc

SEQ ID NO: 2209 - DNA, 39 bp, Artificial Sequence
  Description of Artificial Sequence: Synthetic oligonucleotide
tgcggagcatgggataccagactgaggggttttattttc

SEQ ID NO: 2210 - DNA, 39 bp, Artificial Sequence
  Description of Artificial Sequence: Synthetic oligonucleotide
tgcggagcatgggatactaatttggggaatgttctcctc

SEQ ID NO: 2211 - DNA, 39 bp, Artificial Sequence
  Description of Artificial Sequence: Synthetic oligonucleotide
tgcggggcatgggataccaacctgggtaaatgggttttc

SEQ ID NO: 2212 - DNA, 39 bp, Artificial Sequence
  Description of Artificial Sequence: Synthetic oligonucleotide
tgcggagcatgggataccggccttgagtggtatgttttt

SEQ ID NO: 2213 - DNA, 39 bp, Artificial Sequence
  Description of Artificial Sequence: Synthetic oligonucleotide
tgcggagcatgggataggacttctggattgtggcttttc

SEQ ID NO: 2214 - DNA, 39 bp, Artificial Sequence
  Description of Artificial Sequence: Synthetic oligonucleotide
tgcggagcgtgggatcgtagcctggttgctggactcttc

SEQ ID NO: 2215 - DNA, 39 bp, Artificial Sequence
  Description of Artificial Sequence: Synthetic oligonucleotide
tgcggagcgtgggatagaagcctgactgtttatgtcttc

SEQ ID NO: 2216 - DNA, 39 bp, Artificial Sequence
  Description of Artificial Sequence: Synthetic oligonucleotide
tgcggagcatgggatagaagcctgagtggttatgtcttc

SEQ ID NO: 2217 - DNA, 39 bp, Artificial Sequence
  Description of Artificial Sequence: Synthetic oligonucleotide
tgcggagcatgggatagaagcctgagtgcttatgtcttc

SEQ ID NO: 2218 - DNA, 39 bp, Artificial Sequence
  Description of Artificial Sequence: Synthetic oligonucleotide
tgcggagcatgggatagaagcctgagtgcggtggtattc

SEQ ID NO: 2219 - DNA, 39 bp, Artificial Sequence
  Description of Artificial Sequence: Synthetic oligonucleotide
tgcggagcatgggatcgcagcctgagtgctggggttttc

SEQ ID NO: 2220 - DNA, 39 bp, Artificial Sequence
  Description of Artificial Sequence: Synthetic oligonucleotide
tgcggagcgtgggatcgcagcctgcgtattgtggtattc

SEQ ID NO: 2221 - DNA, 39 bp, Artificial Sequence
  Description of Artificial Sequence: Synthetic oligonucleotide
tgcggagcatgggatagaagtctgagggcttacgtcttc

SEQ ID NO: 2222 - DNA, 39 bp, Artificial Sequence
  Description of Artificial Sequence: Synthetic oligonucleotide
tgcggagcatgggatagaagtctgaatgtttggctgttc

SEQ ID NO: 2223 - DNA, 42 bp, Artificial Sequence
  Description of Artificial Sequence: Synthetic oligonucleotide
tgcggcgcctgggataggggcctgaatgtcggttggcttttc

SEQ ID NO: 2224 - DNA, 39 bp, Artificial Sequence
  Description of Artificial Sequence: Synthetic oligonucleotide
tgcggcgcatgggataatagactgagtattttggccttc

SEQ ID NO: 2225 - DNA, 39 bp, Artificial Sequence
  Description of Artificial Sequence: Synthetic oligonucleotide
tgcggagcttgggataatgacctgacagcttatgtcttc

SEQ ID NO: 2226 - DNA, 36 bp, Artificial Sequence
  Description of Artificial Sequence: Synthetic oligonucleotide
tgcggggcatgggatttcagcctgactcctctcttc

SEQ ID NO: 2227 - DNA, 45 bp, Artificial Sequence
  Description of Artificial Sequence: Synthetic oligonucleotide
tgcggagcctgggatgactatcggggtgtgagtatttatgtcttc

SEQ ID NO: 2228 - DNA, 42 bp, Artificial Sequence
  Description of Artificial Sequence: Synthetic oligonucleotide
tgtggagcatgggatgaccggccttcgagtgccgtggttttc

SEQ ID NO: 2229 - DNA, 39 bp, Artificial Sequence
  Description of Artificial Sequence: Synthetic oligonucleotide
tgcggagcatgggatgacagactgactgtcgttgttttc

SEQ ID NO: 2230 - DNA, 36 bp, Artificial Sequence
  Description of Artificial Sequence: Synthetic oligonucleotide
tgcggagcgtgggatgacaggctgggtgctgtgttc

SEQ ID NO: 2231 - DNA, 42 bp, Artificial Sequence
  Description of Artificial Sequence: Synthetic oligonucleotide
tgcggagcgtgggatgccagcctgaatcctggccgggcattc

SEQ ID NO: 2232 - DNA, 36 bp, Artificial Sequence
  Description of Artificial Sequence: Synthetic oligonucleotide
tgcggagcatgggatgccggcctgagggaaattttc

SEQ ID NO: 2233 - DNA, 39 bp, Artificial Sequence
  Description of Artificial Sequence: Synthetic oligonucleotide
tgcggagcttgggctggcagtccgagtccttgggttttc

SEQ ID NO: 2234 - DNA, 39 bp, Artificial Sequence
  Description of Artificial Sequence: Synthetic oligonucleotide
tgcggagcattcgacaccaccctgagtgctggcgttttc

SEQ ID NO: 2235 - DNA, 39 bp, Artificial Sequence
  Description of Artificial Sequence: Synthetic oligonucleotide
tgcgaaacatgggagagcagcctgagtgttggggtcttc

SEQ ID NO: 2236 - DNA, 39 bp, Artificial Sequence
  Description of Artificial Sequence: Synthetic oligonucleotide
tgcgaaacatgggaaagcagcctgagggtttgggtgttc

SEQ ID NO: 2237 - DNA, 39 bp, Artificial Sequence
  Description of Artificial Sequence: Synthetic oligonucleotide
tgcgaaacgtgggataccagcctgagtggtggggtgttc

SEQ ID NO: 2238 - DNA, 42 bp, Artificial Sequence
  Description of Artificial Sequence: Synthetic oligonucleotide
tgcgaaacatgggataccagcctgagtgacttttatgtcttc

SEQ ID NO: 2239 - DNA, 36 bp, Artificial Sequence
  Description of Artificial Sequence: Synthetic oligonucleotide
tgcgaaacatgggataccagcctgagtgccctcttc

SEQ ID NO: 2240 - DNA, 39 bp, Artificial Sequence
  Description of Artificial Sequence: Synthetic oligonucleotide
tgcgaaacatgggataccagcctgcgtgctgaagtcttc

SEQ ID NO: 2241 - DNA, 39 bp, Artificial Sequence
  Description of Artificial Sequence: Synthetic oligonucleotide
tgcgaaacatgggataccagcctgaatgttgtggtattc

SEQ ID NO: 2242 - DNA, 39 bp, Artificial Sequence
  Description of Artificial Sequence: Synthetic oligonucleotide
tgcgaaacatgggataccagcctgggtgccgtggtgttc

SEQ ID NO: 2243 - DNA, 39 bp, Artificial Sequence
  Description of Artificial Sequence: Synthetic oligonucleotide
tgcgaaacatgggatagaagcctgagtggtgtggtattc

SEQ ID NO: 2244 - DNA, 39 bp, Artificial Sequence
  Description of Artificial Sequence: Synthetic oligonucleotide
tgcgaaacatgggataggagcctgagtgcttgggtgttt

SEQ ID NO: 2245 - DNA, 39 bp, Artificial Sequence
  Description of Artificial Sequence: Synthetic oligonucleotide
tgcgaaacatgggatcgcagcctgagtgctgtggtcttc

SEQ ID NO: 2246 - DNA, 39 bp, Artificial Sequence
  Description of Artificial Sequence: Synthetic oligonucleotide
tgcgagacgtgggatagaggcctgagtgttgtggttttc

SEQ ID NO: 2247 - DNA, 39 bp, Artificial Sequence
  Description of Artificial Sequence: Synthetic oligonucleotide
tgcgaaacatgggataggggcctgagtgcagtggtattc

SEQ ID NO: 2248 - DNA, 39 bp, Artificial Sequence
  Description of Artificial Sequence: Synthetic oligonucleotide
tgcgaaacatgggatcacaccctgagtgttgtgatattc

SEQ ID NO: 2249 - DNA, 39 bp, Artificial Sequence
  Description of Artificial Sequence: Synthetic oligonucleotide
tgcgaaacatgggatgccagcctgactgttgtgttattc

SEQ ID NO: 2250 - DNA, 39 bp, Artificial Sequence
  Description of Artificial Sequence: Synthetic oligonucleotide
tgcgaaacatgggatgccagcctgagtgctggggtgttc

SEQ ID NO: 2251 - DNA, 39 bp, Artificial Sequence
  Description of Artificial Sequence: Synthetic oligonucleotide
tgcgaaacgtgggatgccggcctgagtgaggtggtgttc

SEQ ID NO: 2252 - DNA, 39 bp, Artificial Sequence
  Description of Artificial Sequence: Synthetic oligonucleotide
tgcgaaacatttgataccagcctgagtgttgtagtcttc

SEQ ID NO: 2253 - DNA, 39 bp, Artificial Sequence
  Description of Artificial Sequence: Synthetic oligonucleotide
tgcgaaacatttgataccagcctaaatattgtagtcttt

SEQ ID NO: 2254 - DNA, 39 bp, Artificial Sequence
  Description of Artificial Sequence: Synthetic oligonucleotide
tgcgaatcatgggatagaagccggattggtgtggtcttc

SEQ ID NO: 2255 - DNA, 39 bp, Artificial Sequence
  Description of Artificial Sequence: Synthetic oligonucleotide
tgcgaaagttgggacaggagtctgagtgcccgggtgtac

SEQ ID NO: 2256 - DNA, 39 bp, Artificial Sequence
  Description of Artificial Sequence: Synthetic oligonucleotide
tgcgaatcctgggataggagcctgcgtgccgtggtcttc

SEQ ID NO: 2257 - DNA, 36 bp, Artificial Sequence
  Description of Artificial Sequence: Synthetic oligonucleotide
tgcgaatcttgggatcgtagtttgattgtggtgttc

SEQ ID NO: 2258 - DNA, 39 bp, Artificial Sequence
  Description of Artificial Sequence: Synthetic oligonucleotide
tgcgaaagttgggataacaatttaaatgaggtggttttc

SEQ ID NO: 2259 - DNA, 45 bp, Artificial Sequence
  Description of Artificial Sequence: Synthetic oligonucleotide
tgcgaaatatgggagagcagcccgagtgctgacgatttggtgttc

SEQ ID NO: 2260 - DNA, 39 bp, Artificial Sequence
  Description of Artificial Sequence: Synthetic oligonucleotide
tgcgaagcatgggataccagcctgagtggtgcggtgttc

SEQ ID NO: 2261 - DNA, 39 bp, Artificial Sequence
  Description of Artificial Sequence: Synthetic oligonucleotide
tgcgaagcatgggataccagcctgagtgccggggtgttc

SEQ ID NO: 2262 - DNA, 39 bp, Artificial Sequence
  Description of Artificial Sequence: Synthetic oligonucleotide
tgcgaagcatgggataccagcctgggtggtggggtgttc

SEQ ID NO: 2263 - DNA, 39 bp, Artificial Sequence
  Description of Artificial Sequence: Synthetic oligonucleotide
tgcgaagcatgggatcgcagcctgactggtagcctgttc

SEQ ID NO: 2264 - DNA, 39 bp, Artificial Sequence
  Description of Artificial Sequence: Synthetic oligonucleotide
tgcgaagcgtgggataggggcctgagtgcagtggtattc

SEQ ID NO: 2265 - DNA, 39 bp, Artificial Sequence
  Description of Artificial Sequence: Synthetic oligonucleotide
tgcgaagcctgggataacatcctgagtactgtggtgttc

SEQ ID NO: 2266 - DNA, 39 bp, Artificial Sequence
  Description of Artificial Sequence: Synthetic oligonucleotide
tgcgaagcatgggacatcagcctgagtgctggggtgttc

SEQ ID NO: 2267 - DNA, 39 bp, Artificial Sequence
  Description of Artificial Sequence: Synthetic oligonucleotide
tgcgaagcatgggatgccgacctgagtggtgcggtgttc

SEQ ID NO: 2268 - DNA, 45 bp, Artificial Sequence
  Description of Artificial Sequence: Synthetic oligonucleotide
tgcgcaacatggactggtagtttcagaactggccattatgtcttc

SEQ ID NO: 2269 - DNA, 39 bp, Artificial Sequence
  Description of Artificial Sequence: Synthetic oligonucleotide
tgcgcaacatggagtagcagtcccagggggtgggtgttc

SEQ ID NO: 2270 - DNA, 42 bp, Artificial Sequence
  Description of Artificial Sequence: Synthetic oligonucleotide
tgcgcaacatggcattacagcctgagtgctggccgagtgttc

SEQ ID NO: 2271 - DNA, 39 bp, Artificial Sequence
  Description of Artificial Sequence: Synthetic oligonucleotide
tgcgcaacatggcataccagcctgagtattgtgcagttc

SEQ ID NO: 2272 - DNA, 42 bp, Artificial Sequence
  Description of Artificial Sequence: Synthetic oligonucleotide
tgcgcaacatggcatagcaccctgagtgctgatgtgcttttc

SEQ ID NO: 2273 - DNA, 42 bp, Artificial Sequence
  Description of Artificial Sequence: Synthetic oligonucleotide
tgcgcaacatggcatagcagcctgagtgctggccgactcttc

SEQ ID NO: 2274 - DNA, 39 bp, Artificial Sequence
  Description of Artificial Sequence: Synthetic oligonucleotide
tgcgcaacatggcatatcgctcggagtgcctgggtgttc

SEQ ID NO: 2275 - DNA, 39 bp, Artificial Sequence
  Description of Artificial Sequence: Synthetic oligonucleotide
tgcgcaacatggggtagtagtcagagtgccgtggtattc

SEQ ID NO: 2276 - DNA, 42 bp, Artificial Sequence
  Description of Artificial Sequence: Synthetic oligonucleotide
tgcgcaacatggggtagcagcctgagtgctgggggtgttttc

SEQ ID NO: 2277 - DNA, 39 bp, Artificial Sequence
  Description of Artificial Sequence: Synthetic oligonucleotide
tgtgcaacatgggaatacagcctgagtgttgtgctgttc

SEQ ID NO: 2278 - DNA, 42 bp, Artificial Sequence
  Description of Artificial Sequence: Synthetic oligonucleotide
tgcgcaacatgggagaccacccgacgtgcctcttttgtcttc

SEQ ID NO: 2279 - DNA, 39 bp, Artificial Sequence
  Description of Artificial Sequence: Synthetic oligonucleotide
tgcgcaacatgggagaccagcctgaatgtttatgtcttc

SEQ ID NO: 2280 - DNA, 39 bp, Artificial Sequence
  Description of Artificial Sequence: Synthetic oligonucleotide
tgcgcaacatgggaaactagcctgaatgttgtggtcttc

SEQ ID NO: 2281 - DNA, 39 bp, Artificial Sequence
  Description of Artificial Sequence: Synthetic oligonucleotide
tgcgcaacatgggagaccagcctgaatctttatgtcttc

SEQ ID NO: 2282 - DNA, 42 bp, Artificial Sequence
  Description of Artificial Sequence: Synthetic oligonucleotide
tgcgcaacatgggagactggcctaagtgctggagaggtgttc

SEQ ID NO: 2283 - DNA, 39 bp, Artificial Sequence
  Description of Artificial Sequence: Synthetic oligonucleotide
tgcgcgacgtgggagagtaccctaagtgttgtggttttc

SEQ ID NO: 2284 - DNA, 39 bp, Artificial Sequence
  Description of Artificial Sequence: Synthetic oligonucleotide
tgcgcaacgtgggagagcagcctgagtatttttgtcttc

SEQ ID NO: 2285 - DNA, 42 bp, Artificial Sequence
  Description of Artificial Sequence: Synthetic oligonucleotide
tgcgcaacatgggaaagcagcctcaacactttttatgtcttc

SEQ ID NO: 2286 - DNA, 45 bp, Artificial Sequence
  Description of Artificial Sequence: Synthetic oligonucleotide
tgcgcaacatgggagagtagggtggatactcgagggttgttattc

SEQ ID NO: 2287 - DNA, 42 bp, Artificial Sequence
  Description of Artificial Sequence: Synthetic oligonucleotide
tgcgcaacatgggagagcggcctgagtggtgcgggggtgttc

SEQ ID NO: 2288 - DNA, 42 bp, Artificial Sequence
  Description of Artificial Sequence: Synthetic oligonucleotide
tgcgcaacatgggaaggcagcctcaacactttttatgtcttc

SEQ ID NO: 2289 - DNA, 39 bp, Artificial Sequence
  Description of Artificial Sequence: Synthetic oligonucleotide
tgcgcaacttgggattatagcctgagtgctgtggtgttc

SEQ ID NO: 2290 - DNA, 39 bp, Artificial Sequence
  Description of Artificial Sequence: Synthetic oligonucleotide
tgcgcaacatgggattacagactgagtattgtggtattc

SEQ ID NO: 2291 - DNA, 39 bp, Artificial Sequence
  Description of Artificial Sequence: Synthetic oligonucleotide
tgcgcaacatgggattataacctgggagctgcggtgttc

SEQ ID NO: 2292 - DNA, 39 bp, Artificial Sequence
  Description of Artificial Sequence: Synthetic oligonucleotide
tgcgccacatgggatgtcaccctgggtgtcttgcatttc

SEQ ID NO: 2293 - DNA, 39 bp, Artificial Sequence
  Description of Artificial Sequence: Synthetic oligonucleotide
tgcgcaacatgggatacaacactgagtgtctgggtcttc

SEQ ID NO: 2294 - DNA, 39 bp, Artificial Sequence
  Description of Artificial Sequence: Synthetic oligonucleotide
tgcgcaacatgggataccaccctgagtgtagtacttttc

SEQ ID NO: 2295 - DNA, 39 bp, Artificial Sequence
  Description of Artificial Sequence: Synthetic oligonucleotide
tgcgcaacatgggataccaccctgagtgttgaggtcttc

SEQ ID NO: 2296 - DNA, 48 bp, Artificial Sequence
  Description of Artificial Sequence: Synthetic oligonucleotide
tgcgcaacatgggataccagccccagcctgagtggtttttgggtgttc

SEQ ID NO: 2297 - DNA, 39 bp, Artificial Sequence
  Description of Artificial Sequence: Synthetic oligonucleotide
tgcgcaacatgggataccagcctgactggtgtggtattc

SEQ ID NO: 2298 - DNA, 39 bp, Artificial Sequence
  Description of Artificial Sequence: Synthetic oligonucleotide
tgcgcaacatgggataccagcctgactggtgcggtgttc

SEQ ID NO: 2299 - DNA, 39 bp, Artificial Sequence
  Description of Artificial Sequence: Synthetic oligonucleotide
tgcgcaacatgggataccagcctgactgcctgggtattc

SEQ ID NO: 2300 - DNA, 39 bp, Artificial Sequence
  Description of Artificial Sequence: Synthetic oligonucleotide
tgcgcaacatgggataccagcctgactgctgtggttttc

SEQ ID NO: 2301 - DNA, 39 bp, Artificial Sequence
  Description of Artificial Sequence: Synthetic oligonucleotide
tgcgcaacatgggatactagcctgactgctaaggtgttc

SEQ ID NO: 2302 - DNA, 39 bp, Artificial Sequence
  Description of Artificial Sequence: Synthetic oligonucleotide
tgcgcaacatgggacaccagcctgagtgttgtggttttc

SEQ ID NO: 2303 - DNA, 39 bp, Artificial Sequence
  Description of Artificial Sequence: Synthetic oligonucleotide
tgcgctacttgggataccagcctgagtgttggggtattt

SEQ ID NO: 2304 - DNA, 39 bp, Artificial Sequence
  Description of Artificial Sequence: Synthetic oligonucleotide
tgcgcaacatgggataccagcctgagttcttgggtgttc

SEQ ID NO: 2305 - DNA, 39 bp, Artificial Sequence
  Description of Artificial Sequence: Synthetic oligonucleotide
tgcgcaacatgggataccagcctgagtggtggggtactc

SEQ ID NO: 2306 - DNA, 39 bp, Artificial Sequence
  Description of Artificial Sequence: Synthetic oligonucleotide
tgcgcaacatgggataccagcctgagtggtggggtgttc

SEQ ID NO: 2307 - DNA, 42 bp, Artificial Sequence
  Description of Artificial Sequence: Synthetic oligonucleotide
tgcgcaacatgggataccagcctgagtggtggccgagtgttc

SEQ ID NO: 2308 - DNA, 42 bp, Artificial Sequence
  Description of Artificial Sequence: Synthetic oligonucleotide
tgcgcaacatgggataccagcctgagtggtgaccgagtgttc

SEQ ID NO: 2309 - DNA, 39 bp, Artificial Sequence
  Description of Artificial Sequence: Synthetic oligonucleotide
tgcgcaacgtgggatactagcctgagtgaaggggtgttc

SEQ ID NO: 2310 - DNA, 39 bp, Artificial Sequence
  Description of Artificial Sequence: Synthetic oligonucleotide
tgcgcaacctgggataccagcctgagtgccgtggtgctc

SEQ ID NO: 2311 - DNA, 36 bp, Artificial Sequence
  Description of Artificial Sequence: Synthetic oligonucleotide
tgcgcaacatgggataccagcctgagtgctgtcttc

SEQ ID NO: 2312 - DNA, 39 bp, Artificial Sequence
  Description of Artificial Sequence: Synthetic oligonucleotide
tgcgcgacatgggataccagcctgagtgctcgggtgttc

SEQ ID NO: 2313 - DNA, 36 bp, Artificial Sequence
  Description of Artificial Sequence: Synthetic oligonucleotide
tgcgcaacatgggataccagcctgagtgccttattc

SEQ ID NO: 2314 - DNA, 39 bp, Artificial Sequence
  Description of Artificial Sequence: Synthetic oligonucleotide
tgcgcaacatgggataccagcctgagtgctcatgtcttc

SEQ ID NO: 2315 - DNA, 42 bp, Artificial Sequence
  Description of Artificial Sequence: Synthetic oligonucleotide
tgcgcaacatgggataccagcctgagtgctggccgggtgttc

SEQ ID NO: 2316 - DNA, 39 bp, Artificial Sequence
  Description of Artificial Sequence: Synthetic oligonucleotide
tgcgcaacatgggataccagcctgagtgcggaggtcttc

SEQ ID NO: 2317 - DNA, 51 bp, Artificial Sequence
  Description of Artificial Sequence: Synthetic oligonucleotide
tgcgcaacatgggataccagcctgagtgctgatgctggtgggggggtcttc

SEQ ID NO: 2318 - DNA, 39 bp, Artificial Sequence
  Description of Artificial Sequence: Synthetic oligonucleotide
tgcgcaacatgggataccagcctgcgtgtcgtggtattc

SEQ ID NO: 2319 - DNA, 36 bp, Artificial Sequence
  Description of Artificial Sequence: Synthetic oligonucleotide
tgcgcaacatgggataccagcctgagaggggtgttc

SEQ ID NO: 2320 - DNA, 39 bp, Artificial Sequence
  Description of Artificial Sequence: Synthetic oligonucleotide
tgcgcaacatgggataccagcctgcctgcgtgggtgttc

SEQ ID NO: 2321 - DNA, 39 bp, Artificial Sequence
  Description of Artificial Sequence: Synthetic oligonucleotide
tgtgcaacatgggataccagcctgaatgttggggtattc

SEQ ID NO: 2322 - DNA, 39 bp, Artificial Sequence
  Description of Artificial Sequence: Synthetic oligonucleotide
tgcgcaacatgggataccagcctgggtattgtgttattt

SEQ ID NO: 2323 - DNA, 42 bp, Artificial Sequence
  Description of Artificial Sequence: Synthetic oligonucleotide
tgcgcaacatgggacaccagcctgggtgcgcgtgtggtcttc

SEQ ID NO: 2324 - DNA, 36 bp, Artificial Sequence
  Description of Artificial Sequence: Synthetic oligonucleotide
tgtgcaacgtgggataccagtctaggtgccttgttc

SEQ ID NO: 2325 - DNA, 39 bp, Artificial Sequence
  Description of Artificial Sequence: Synthetic oligonucleotide
tgcgcaacatgggataccagcctggcgactggactgttc

SEQ ID NO: 2326 - DNA, 39 bp, Artificial Sequence
  Description of Artificial Sequence: Synthetic oligonucleotide
tgcgcaacatgggataccagcctggctgcctgggtattc

SEQ ID NO: 2327 - DNA, 39 bp, Artificial Sequence
  Description of Artificial Sequence: Synthetic oligonucleotide
tgcgcaacctgggataccaggctgagtgctgtggtcttc

SEQ ID NO: 2328 - DNA, 39 bp, Artificial Sequence
  Description of Artificial Sequence: Synthetic oligonucleotide
tgcgcaacatgggataccaggctgagtgctggggtgttc

SEQ ID NO: 2329 - DNA, 39 bp, Artificial Sequence
  Description of Artificial Sequence: Synthetic oligonucleotide
tgtgcaacgtgggacacacgtctacttattacggttttc

SEQ ID NO: 2330 - DNA, 39 bp, Artificial Sequence
  Description of Artificial Sequence: Synthetic oligonucleotide
tgcgcaacatgggacaccctcctgagtgttgaactcttc

SEQ ID NO: 2331 - DNA, 42 bp, Artificial Sequence
  Description of Artificial Sequence: Synthetic oligonucleotide
tgcgcaacatgggatactggccgcaatcctcatgtggtcttc

SEQ ID NO: 2332 - DNA, 39 bp, Artificial Sequence
  Description of Artificial Sequence: Synthetic oligonucleotide
tgcgcaacatgggataccggcctgtcttcggtgttgttc

SEQ ID NO: 2333 - DNA, 36 bp, Artificial Sequence
  Description of Artificial Sequence: Synthetic oligonucleotide
tgcgcaacgtgggataccggcctgagtgcggttttc

SEQ ID NO: 2334 - DNA, 39 bp, Artificial Sequence
  Description of Artificial Sequence: Synthetic oligonucleotide
tgcgctacgtgggataggaccctgagtattggagtcttc

SEQ ID NO: 2335 - DNA, 39 bp, Artificial Sequence
  Description of Artificial Sequence: Synthetic oligonucleotide
tgcgcaacgtgggatcgcagtgtgactgctgtgctcttc

SEQ ID NO: 2336 - DNA, 39 bp, Artificial Sequence
  Description of Artificial Sequence: Synthetic oligonucleotide
tgcgcaacctgggataggagcctgagtggtgtggtgttc

SEQ ID NO: 2337 - DNA, 39 bp, Artificial Sequence
  Description of Artificial Sequence: Synthetic oligonucleotide
tgcgcaacatgggatagaagcctgagtgctgtggtcttc

SEQ ID NO: 2338 - DNA, 45 bp, Artificial Sequence
  Description of Artificial Sequence: Synthetic oligonucleotide
tgcgcaacatgggatagaagcctgagtgctgttccttgggtgttc

SEQ ID NO: 2339 - DNA, 39 bp, Artificial Sequence
  Description of Artificial Sequence: Synthetic oligonucleotide
tgcgcaacatgggatcgcagcctgagtgctggggtgttc

SEQ ID NO: 2340 - DNA, 39 bp, Artificial Sequence
  Description of Artificial Sequence: Synthetic oligonucleotide
tgcgcaacgtgggataggagcctgcgtgctggggtgttc

SEQ ID NO: 2341 - DNA, 39 bp, Artificial Sequence
  Description of Artificial Sequence: Synthetic oligonucleotide
tgcgcaacatgggatcgcagtctgaatgtttatgtcctc

SEQ ID NO: 2342 - DNA, 39 bp, Artificial Sequence
  Description of Artificial Sequence: Synthetic oligonucleotide
tgcgcaacgtgggatcgcatcctgagcgctgaggtgttc

SEQ ID NO: 2343 - DNA, 39 bp, Artificial Sequence
  Description of Artificial Sequence: Synthetic oligonucleotide
tgcgcaacgtgggatagaggcctgagtactggggtgttc

SEQ ID NO: 2344 - DNA, 39 bp, Artificial Sequence
  Description of Artificial Sequence: Synthetic oligonucleotide
tgcgcaacatgggataactacctgggtgctgccgtgttc

SEQ ID NO: 2345 - DNA, 42 bp, Artificial Sequence
  Description of Artificial Sequence: Synthetic oligonucleotide
tgcgcaacatgggataacacgccttcgaatattgtggtattc

SEQ ID NO: 2346 - DNA, 39 bp, Artificial Sequence
  Description of Artificial Sequence: Synthetic oligonucleotide
tgcgcaacatgggataatacactgagtgtgtgggtcttc

SEQ ID NO: 2347 - DNA, 42 bp, Artificial Sequence
  Description of Artificial Sequence: Synthetic oligonucleotide
tgcgcaacatgggataacaccctgagtgtcaattgggtgttc

SEQ ID NO: 2348 - DNA, 42 bp, Artificial Sequence
  Description of Artificial Sequence: Synthetic oligonucleotide
tgcgcaacctgggataacacactgaatgtcttttatgttttc

SEQ ID NO: 2349 - DNA, 39 bp, Artificial Sequence
  Description of Artificial Sequence: Synthetic oligonucleotide
tgtgcgacatgggataatcggctcagttctgtggtcttc

SEQ ID NO: 2350 - DNA, 39 bp, Artificial Sequence
  Description of Artificial Sequence: Synthetic oligonucleotide
tgcgcaacatgggataaccgcctgagtgctggggtgctc

SEQ ID NO: 2351 - DNA, 39 bp, Artificial Sequence
  Description of Artificial Sequence: Synthetic oligonucleotide
tgcgcaacgtgggataacaggctgagtgctggggtgttc

SEQ ID NO: 2352 - DNA, 33 bp, Artificial Sequence
  Description of Artificial Sequence: Synthetic oligonucleotide
tgcgcaacatgggataacagggattgggtcttc

SEQ ID NO: 2353 - DNA, 39 bp, Artificial Sequence
  Description of Artificial Sequence: Synthetic oligonucleotide
tgcgcaacatgggataacaacctgggtgctggggtgttc

SEQ ID NO: 2354 - DNA, 39 bp, Artificial Sequence
  Description of Artificial Sequence: Synthetic oligonucleotide
tgcgcaacatgggataacaagctgacttctggggtcttc

SEQ ID NO: 2355 - DNA, 39 bp, Artificial Sequence
  Description of Artificial Sequence: Synthetic oligonucleotide
tgcgcaacatgggataacatcctgagtgcctgggtgttt

SEQ ID NO: 2356 - DNA, 39 bp, Artificial Sequence
  Description of Artificial Sequence: Synthetic oligonucleotide
tgcgcaacctgggacaacgatatacattctgggctgttc

SEQ ID NO: 2357 - DNA, 36 bp, Artificial Sequence
  Description of Artificial Sequence: Synthetic oligonucleotide
tgcgcaacttgggatctcagcctgagtgccctgttc

SEQ ID NO: 2358 - DNA, 39 bp, Artificial Sequence
  Description of Artificial Sequence: Synthetic oligonucleotide
tgcgcaacatgggatatcaccctgagtgctgaggtgttc

SEQ ID NO: 2359 - DNA, 42 bp, Artificial Sequence
  Description of Artificial Sequence: Synthetic oligonucleotide
tgcgcaacgtgggatatcagcccgagtgctggcggggtgttc

SEQ ID NO: 2360 - DNA, 45 bp, Artificial Sequence
  Description of Artificial Sequence: Synthetic oligonucleotide
tgcgcaacatgggatatcagtctaagtactggccgggctgtgttc

SEQ ID NO: 2361 - DNA, 36 bp, Artificial Sequence
  Description of Artificial Sequence: Synthetic oligonucleotide
tgcgcaacatgggatatcagtctgagtcaggtattc

SEQ ID NO: 2362 - DNA, 39 bp, Artificial Sequence
  Description of Artificial Sequence: Synthetic oligonucleotide
tgcgcaacatgggatatcaggctgagtagtggagtgttc

SEQ ID NO: 2363 - DNA, 42 bp, Artificial Sequence
  Description of Artificial Sequence: Synthetic oligonucleotide
tgcgcaacgtgggatatcggcccgagtgctggcggggtgttc

SEQ ID NO: 2364 - DNA, 39 bp, Artificial Sequence
  Description of Artificial Sequence: Synthetic oligonucleotide
tgcgcaacatgggatcacagccgggctggtgtgctattc

SEQ ID NO: 2365 - DNA, 42 bp, Artificial Sequence
  Description of Artificial Sequence: Synthetic oligonucleotide
tgcgcaacatgggatcacagtccgagtgttggagaagtcttc

SEQ ID NO: 2366 - DNA, 39 bp, Artificial Sequence
  Description of Artificial Sequence: Synthetic oligonucleotide
tgcgcaacatgggatcacagcctgcgtgttggggtgttc

SEQ ID NO: 2367 - DNA, 39 bp, Artificial Sequence
  Description of Artificial Sequence: Synthetic oligonucleotide
tgcgcaacatgggatcacagcctgaacattggggtgttc

SEQ ID NO: 2368 - DNA, 39 bp, Artificial Sequence
  Description of Artificial Sequence: Synthetic oligonucleotide
tgcgcaacatgggatcacagcctgggtctttgggcattc

SEQ ID NO: 2369 - DNA, 36 bp, Artificial Sequence
  Description of Artificial Sequence: Synthetic oligonucleotide
tgcgccacatgggatcacaatctgcgtcttgttttc

SEQ ID NO: 2370 - DNA, 39 bp, Artificial Sequence
  Description of Artificial Sequence: Synthetic oligonucleotide
tgcgcgacttgggatcacatcctggcttctggggtgttc

SEQ ID NO: 2371 - DNA, 39 bp, Artificial Sequence
  Description of Artificial Sequence: Synthetic oligonucleotide
tgcgcaacatgggatttcagcctgagtgtttgggtgttc

SEQ ID NO: 2372 - DNA, 39 bp, Artificial Sequence
  Description of Artificial Sequence: Synthetic oligonucleotide
tgcgcaacatgggatttcagcctgagtgcttgggtgttc

SEQ ID NO: 2373 - DNA, 39 bp, Artificial Sequence
  Description of Artificial Sequence: Synthetic oligonucleotide
tgcgcaacatgggatgacaccctcactgctggtgtgttc

SEQ ID NO: 2374 - DNA, 39 bp, Artificial Sequence
  Description of Artificial Sequence: Synthetic oligonucleotide
tgcgcaacatgggacgacaggctgagtgctgtgcttttc

SEQ ID NO: 2375 - DNA, 39 bp, Artificial Sequence
  Description of Artificial Sequence: Synthetic oligonucleotide
tgcgcaacatgggatgacaggctggatgctgcggtgttc

SEQ ID NO: 2376 - DNA, 39 bp, Artificial Sequence
  Description of Artificial Sequence: Synthetic oligonucleotide
tgcgcaacatgggatgcgaccctgaatactggggtgttc

SEQ ID NO: 2377 - DNA, 39 bp, Artificial Sequence
  Description of Artificial Sequence: Synthetic oligonucleotide
tgcgcaacatgggatgccagcctgagtgtttggctgctc

SEQ ID NO: 2378 - DNA, 39 bp, Artificial Sequence
  Description of Artificial Sequence: Synthetic oligonucleotide
tgcgcgacatgggatgccagcctgagtggtggggtgttc

SEQ ID NO: 2379 - DNA, 39 bp, Artificial Sequence
  Description of Artificial Sequence: Synthetic oligonucleotide
tgcgcaacacgggataccaccctcagcgccgttctgttc

SEQ ID NO: 2380 - DNA, 39 bp, Artificial Sequence
  Description of Artificial Sequence: Synthetic oligonucleotide
tgcgctacattgggtagtagcctgagtctctgggtgttc

SEQ ID NO: 2381 - DNA, 39 bp, Artificial Sequence
  Description of Artificial Sequence: Synthetic oligonucleotide
tgcgcaacaatcgaaactagcctgcctgcctgggtattc

SEQ ID NO: 2382 - DNA, 39 bp, Artificial Sequence
  Description of Artificial Sequence: Synthetic oligonucleotide
tgcgcaacaggggacagaagcctgactgttgaggtattc

SEQ ID NO: 2383 - DNA, 36 bp, Artificial Sequence
  Description of Artificial Sequence: Synthetic oligonucleotide
tgcgctacaggggatctcggcctgaccatagtcttc

SEQ ID NO: 2384 - DNA, 42 bp, Artificial Sequence
  Description of Artificial Sequence: Synthetic oligonucleotide
tgcgcatcatgggattacagggggagatctggttgggtgttc

SEQ ID NO: 2385 - DNA, 39 bp, Artificial Sequence
  Description of Artificial Sequence: Synthetic oligonucleotide
tgcgcatcatgggataccaccctgaatgttggggtgttc

SEQ ID NO: 2386 - DNA, 39 bp, Artificial Sequence
  Description of Artificial Sequence: Synthetic oligonucleotide
tgcgcttcatgggataccaccctgggttttgtgttattc

SEQ ID NO: 2387 - DNA, 42 bp, Artificial Sequence
  Description of Artificial Sequence: Synthetic oligonucleotide
tgcgcatcatgggataccagcctgagtggtggttatgtcttc

SEQ ID NO: 2388 - DNA, 39 bp, Artificial Sequence
  Description of Artificial Sequence: Synthetic oligonucleotide
tgcgcatcatgggataccagcctccgtgctggggtgttc

SEQ ID NO: 2389 - DNA, 39 bp, Artificial Sequence
  Description of Artificial Sequence: Synthetic oligonucleotide
tgcgcatcatgggataccagcctgggtgctggggtgttc

SEQ ID NO: 2390 - DNA, 39 bp, Artificial Sequence
  Description of Artificial Sequence: Synthetic oligonucleotide
tgcgcatcatgggacagaggcctgagtgcagtggtgttc

SEQ ID NO: 2391 - DNA, 39 bp, Artificial Sequence
  Description of Artificial Sequence: Synthetic oligonucleotide
tgtgctagttgggataacgtcctgcgtggtgtggtattc

SEQ ID NO: 2392 - DNA, 39 bp, Artificial Sequence
  Description of Artificial Sequence: Synthetic oligonucleotide
tgcgcgtcatgggataacaggctgactgccgtggttttc

SEQ ID NO: 2393 - DNA, 36 bp, Artificial Sequence
  Description of Artificial Sequence: Synthetic oligonucleotide
tgcgcatcatgggatgcaagcctgtccgtcgctttc

SEQ ID NO: 2394 - DNA, 39 bp, Artificial Sequence
  Description of Artificial Sequence: Synthetic oligonucleotide
tgcgcttcgtgggatgccggcctgagttcttatgtcttc

SEQ ID NO: 2395 - DNA, 39 bp, Artificial Sequence
  Description of Artificial Sequence: Synthetic oligonucleotide
tgcgcatccggggataccagcctgagtggtgtgatattc

SEQ ID NO: 2396 - DNA, 39 bp, Artificial Sequence
  Description of Artificial Sequence: Synthetic oligonucleotide
tgcgcaagatggcatacgagcctaagtatttgggtcttc

SEQ ID NO: 2397 - DNA, 45 bp, Artificial Sequence
  Description of Artificial Sequence: Synthetic oligonucleotide
tgcgcaatatgggataccggcctgagtcctggccaagttgccttc

SEQ ID NO: 2398 - DNA, 39 bp, Artificial Sequence
  Description of Artificial Sequence: Synthetic oligonucleotide
tgcgcagcatggcatagcggcctgggtctcccggtcttc

SEQ ID NO: 2399 - DNA, 39 bp, Artificial Sequence
  Description of Artificial Sequence: Synthetic oligonucleotide
tgcgcagcatgggattacagcctgagtgctggggtgttc

SEQ ID NO: 2400 - DNA, 39 bp, Artificial Sequence
  Description of Artificial Sequence: Synthetic oligonucleotide
tgcgcagcctgggatactaccctgcgtgttaggctgttc

SEQ ID NO: 2401 - DNA, 39 bp, Artificial Sequence
  Description of Artificial Sequence: Synthetic oligonucleotide
tgcgcagcatgggataccagcctgactgcctgggttttc

SEQ ID NO: 2402 - DNA, 39 bp, Artificial Sequence
  Description of Artificial Sequence: Synthetic oligonucleotide
tgcgcagcatgggataccagcttgagtggtggggtgttc

SEQ ID NO: 2403 - DNA, 42 bp, Artificial Sequence
  Description of Artificial Sequence: Synthetic oligonucleotide
tgcgcagcatgggataccagcctgagtggcgaggctgtgttc

SEQ ID NO: 2404 - DNA, 39 bp, Artificial Sequence
  Description of Artificial Sequence: Synthetic oligonucleotide
tgcgcagcatgggataccagcttgagtggtgcggtgttc

SEQ ID NO: 2405 - DNA, 39 bp, Artificial Sequence
  Description of Artificial Sequence: Synthetic oligonucleotide
tgcgcagcatgggataccagcctgagtgcctgggtgttc

SEQ ID NO: 2406 - DNA, 39 bp, Artificial Sequence
  Description of Artificial Sequence: Synthetic oligonucleotide
tgcgcagcatgggataccagcctgagtgctggggtattc

SEQ ID NO: 2407 - DNA, 39 bp, Artificial Sequence
  Description of Artificial Sequence: Synthetic oligonucleotide
tgcgcagcatgggataccagcctggatacttatgtcttc

SEQ ID NO: 2408 - DNA, 39 bp, Artificial Sequence
  Description of Artificial Sequence: Synthetic oligonucleotide
tgcgctgcatgggatacccgtctgagtggtgtgttattc

SEQ ID NO: 2409 - DNA, 39 bp, Artificial Sequence
  Description of Artificial Sequence: Synthetic oligonucleotide
tgcgcagcatgggataccaggctgagtgctggggtgttc

SEQ ID NO: 2410 - DNA, 39 bp, Artificial Sequence
  Description of Artificial Sequence: Synthetic oligonucleotide
tgcgcagcatgggatcgcagtctgagtactggagttttc

SEQ ID NO: 2411 - DNA, 36 bp, Artificial Sequence
  Description of Artificial Sequence: Synthetic oligonucleotide
tgcgcagcgtgggatatccgccggtctgtccttttc

SEQ ID NO: 2412 - DNA, 36 bp, Artificial Sequence
  Description of Artificial Sequence: Synthetic oligonucleotide
tgcgctgcgtgggatcacactcagcgtctttccttc

SEQ ID NO: 2413 - DNA, 42 bp, Artificial Sequence
  Description of Artificial Sequence: Synthetic oligonucleotide
tgcgcagcatgggatcacagcctgagtgctggccaggtgttc

SEQ ID NO: 2414 - DNA, 39 bp, Artificial Sequence
  Description of Artificial Sequence: Synthetic oligonucleotide
tgcgcagcagtcgatactggtctgaaagaatgggtgttc

SEQ ID NO: 2415 - protein, 35 aa, Artificial Sequence
  Description of Artificial Sequence: Synthetic polypeptide
  MOD_RES (15)..(17): Any amino acid
CARDLRELECEEWTXXXSRGPCVDPRGVAGSFDVW

SEQ ID NO: 2416 - protein, 24 aa, Artificial Sequence
  Description of Artificial Sequence: Synthetic peptide
  MOD_RES (10)..(12): Any amino acid
CARDMYYDFXXXEVVPADDAFDIW

SEQ ID NO: 2417 - protein, 33 aa, Artificial Sequence
  Description of Artificial Sequence: Synthetic polypeptide
  MOD_RES (17)..(19): Any amino acid
CARDGRGSLPRPKGGPXXXYDSSEDSGGAFDIW

SEQ ID NO: 2418 - protein, 21 aa, Artificial Sequence
  Description of Artificial Sequence: Synthetic peptide
  MOD_RES (9)..(11): Any amino acid
CARANQHFXXXGYHYYGMDVW

SEQ ID NO: 2419 - protein, 23 aa, Artificial Sequence
  Description of Artificial Sequence: Synthetic peptide
  MOD_RES (9)..(11): Any amino acid
CAKHMSMQXXXRADLVGDAFDVW

SEQ ID NO: 2420 - protein, 43 aa, Artificial Sequence
  Description of Artificial Sequence: Synthetic polypeptide
CAKHMSMQEGAVTGEGQAAKEFIAWLVKGRVRADLVGDAFDVW

SEQ ID NO: 2421 - protein, 52 aa, Artificial Sequence
  Description of Artificial Sequence: Synthetic polypeptide
CARDGRGSLPRPKGGPQTVGEGQAAKEFIAWLVKGGLTYDSSEDSGGAFDIW

SEQ ID NO: 2422 - protein, 44 aa, Artificial Sequence
  Description of Artificial Sequence: Synthetic polypeptide
CAKHMSMQDYLVIGEGQAAKEFIAWLVKGGPARADLVGDAFDVW

SEQ ID NO: 2423 - protein, 43 aa, Artificial Sequence
  Description of Artificial Sequence: Synthetic polypeptide
CAKHMSMQEGAVTGEGQDAKEFIAWLVKGRVRADLVGDAFDVW

SEQ ID NO: 2424 - protein, 43 aa, Artificial Sequence
  Description of Artificial Sequence: Synthetic polypeptide
WAKHMSMQEGAVTGEGQAAKEFIAWLVKGRVRADLVGDAFDVW

SEQ ID NO: 2425 - protein, 49 aa, Artificial Sequence
  Description of Artificial Sequence: Synthetic polypeptide
CARDGRGSLPRPKGGPQTVGEGQAAKEFIAWLVKGRVRADLVGDAFDVW

SEQ ID NO: 2426 - protein, 51 aa, Artificial Sequence
  Description of Artificial Sequence: Synthetic polypeptide
CARANQHFYEQEGTFTSDVSSYLEGQAAKEFIAWLVKGGIRGYHYYGMDVW

SEQ ID NO: 2427 - protein, 44 aa, Artificial Sequence
  Description of Artificial Sequence: Synthetic polypeptide
CARANQHFTELHGEGQAAKEFIAWLVKGRGQIDIGYHYYGMDVW

SEQ ID NO: 2428 - protein, 45 aa, Artificial Sequence
  Description of Artificial Sequence: Synthetic polypeptide
CARANQHFLGAGVSSYLEGQAAKEFIAWLVKGDTTGYHYYGMDVW

SEQ ID NO: 2429 - protein, 50 aa, Artificial Sequence
  Description of Artificial Sequence: Synthetic polypeptide
CARANQHFLDKGTFTSDVSSYLEGQAAKEFIAWLVKGIYPGYHYYGMDVW

SEQ ID NO: 2430 - protein, 46 aa, Artificial Sequence
  Description of Artificial Sequence: Synthetic polypeptide
CARANQHFGTLSAGEGQAAKEFIAWLVKGGSQYDSSEDSGGAFDIW

SEQ ID NO: 2431 - protein, 43 aa, Artificial Sequence
  Description of Artificial Sequence: Synthetic polypeptide
CARANQHFGLHAQGEGQAAKEFIAWLVKGSGTYGYHYYGMDVW

SEQ ID NO: 2432 - protein, 42 aa, Artificial Sequence
  Description of Artificial Sequence: Synthetic polypeptide
CARANQHFGGKGEGQAAKEFIAWLVKGGGSGAGYHYYGMDVW

SEQ ID NO: 2433 - protein, 43 aa, Artificial Sequence
  Description of Artificial Sequence: Synthetic polypeptide
CAKQMSMQEGAVTGEGQAAKEFIAWLVKGRVRADLVGDAFDVW

SEQ ID NO: 2434 - protein, 44 aa, Artificial Sequence
  Description of Artificial Sequence: Synthetic polypeptide
CAKHMSMQEGAVTGEGQAAKEFIAWLVKGGPARADLVGDAFDVW

SEQ ID NO: 2435 - protein, 46 aa, Artificial Sequence
  Description of Artificial Sequence: Synthetic polypeptide
CAKHMSMQEGAVTGEGQAAKEFIAWLVKGGLTYDSSEDSGGAFDIW

SEQ ID NO: 2436 - protein, 43 aa, Artificial Sequence
  Description of Artificial Sequence: Synthetic polypeptide
CAKHMSMQDYLVIGEGQAAKEFIAWLVKGRVRADLVGDAFDVW

SEQ ID NO: 2437 - protein, 28 aa, Artificial Sequence
  Description of Artificial Sequence: Synthetic peptide
CAMQFTSFDYIWGSYPAAENYNNEMDVW

SEQ ID NO: 2438 - protein, 11 aa, Artificial Sequence
  Description of Artificial Sequence: Synthetic peptide
CQQYSSFPITF

SEQ ID NO: 2439 - protein, 9 aa, Artificial Sequence
  Description of Artificial Sequence: Synthetic peptide
ATFSSYAFN

SEQ ID NO: 2440 - protein, 13 aa, Artificial Sequence
  Description of Artificial Sequence: Synthetic peptide
GRIIPALGVTNYA

SEQ ID NO: 2441 - protein, 12 aa, Artificial Sequence
  Description of Artificial Sequence: Synthetic peptide
RASPNVGSRSLA

SEQ ID NO: 2442 - protein, 7 aa, Artificial Sequence
  Description of Artificial Sequence: Synthetic peptide
GASGRPT

SEQ ID NO: 2443 - protein, 28 aa, Artificial Sequence
  Description of Artificial Sequence: Synthetic peptide
CARAVYNYGSGTSLEDSDYYYYYYMEVW

SEQ ID NO: 2444 - protein, 10 aa, Artificial Sequence
  Description of Artificial Sequence: Synthetic peptide
CQQYGRSQTF

SEQ ID NO: 2445 - protein, 9 aa, Artificial Sequence
  Description of Artificial Sequence: Synthetic peptide
DTFSDYAIT

SEQ ID NO: 2446 - protein, 13 aa, Artificial Sequence
  Description of Artificial Sequence: Synthetic peptide
GGIVPIFGTSKKA

SEQ ID NO: 2447 - protein, 12 aa, Artificial Sequence
  Description of Artificial Sequence: Synthetic peptide
RASQSVTSGHLA

SEQ ID NO: 2448 - protein, 7 aa, Artificial Sequence
  Description of Artificial Sequence: Synthetic peptide
GASSRAT

SEQ ID NO: 2449 - protein, 27 aa, Artificial Sequence
  Description of Artificial Sequence: Synthetic peptide
CARGAAECSMGVCYTRSNYFSFGMDVW

SEQ ID NO: 2450 - protein, 12 aa, Artificial Sequence
  Description of Artificial Sequence: Synthetic peptide
CQQYGDTPPITF

SEQ ID NO: 2451 - protein, 9 aa, Artificial Sequence
  Description of Artificial Sequence: Synthetic peptide
GGFSNYAIS

SEQ ID NO: 2452 - protein, 13 aa, Artificial Sequence
  Description of Artificial Sequence: Synthetic peptide
GGTIPIFDTTHYA

SEQ ID NO: 2453 - protein, 12 aa, Artificial Sequence
  Description of Artificial Sequence: Synthetic peptide
RASRSVTSNYLA

SEQ ID NO: 2454 - protein, 26 aa, Artificial Sequence
  Description of Artificial Sequence: Synthetic peptide
CARGPRWARDIAEGRPGYYHYYLDVW

SEQ ID NO: 2455 - protein, 11 aa, Artificial Sequence [sequence omitted]

SEQ ID NO: 2456 - protein, 8 aa, Artificial Sequence
  Description of Artificial Sequence: Synthetic peptide
DTLSYIIT

SEQ ID NO: 2457 - protein, 13 aa, Artificial Sequence
  Description of Artificial Sequence: Synthetic peptide
GDIIPTLGTTDYE

SEQ ID NO: 2458 - protein, 12 aa, Artificial Sequence
  Description of Artificial Sequence: Synthetic peptide
RASQTVSGKFVA

SEQ ID NO: 2459 - protein, 7 aa, Artificial Sequence
  Description of Artificial Sequence: Synthetic peptide
GASNRAT

SEQ ID NO: 2460 - protein, 27 aa, Artificial Sequence
  Description of Artificial Sequence: Synthetic peptide
CARVNCSSTSCYLRARPTYYYYGMDVW

SEQ ID NO: 2461 - protein, 11 aa, Artificial Sequence [sequence omitted]

SEQ ID NO: 2462 - protein, 9 aa, Artificial Sequence
  Description of Artificial Sequence: Synthetic peptide
GTFSSYAIS

SEQ ID NO: 2463 - protein, 13 aa, Artificial Sequence
  Description of Artificial Sequence: Synthetic peptide
GGIIPIFGTANYA

SEQ ID NO: 2464 - protein, 12 aa, Artificial Sequence
  Description of Artificial Sequence: Synthetic peptide
RASQSVSSSYLA

SEQ ID NO: 2465 - protein, 26 aa, Artificial Sequence
  Description of Artificial Sequence: Synthetic peptide
CASGLLYQFDTSSLTYNKFFYGMDVW

SEQ ID NO: 2466 - protein, 11 aa, Artificial Sequence
  Description of Artificial Sequence: Synthetic peptide
CQHYGDSTGTF

SEQ ID NO: 2467 - protein, 9 aa, Artificial Sequence
  Description of Artificial Sequence: Synthetic peptide
GSFLTYAIS

SEQ ID NO: 2468 - protein, 13 aa, Artificial Sequence
  Description of Artificial Sequence: Synthetic peptide
GRITPVNGKANHA

SEQ ID NO: 2469 - protein, 12 aa, Artificial Sequence
  Description of Artificial Sequence: Synthetic peptide
RASQSVSDTSIA

SEQ ID NO: 2470 - protein, 7 aa, Artificial Sequence
  Description of Artificial Sequence: Synthetic peptide
AASTRVT

SEQ ID NO: 2471 - protein, 26 aa, Artificial Sequence
  Description of Artificial Sequence: Synthetic peptide
CASGPLYGFDTSSLTYSQLFYGMDVW

SEQ ID NO: 2472 - protein, 9 aa, Artificial Sequence
  Description of Artificial Sequence: Synthetic peptide
GTLVTHAIT

SEQ ID NO: 2473 - protein, 13 aa, Artificial Sequence
  Description of Artificial Sequence: Synthetic peptide
GRITPINGKANHA

SEQ ID NO: 2474 - protein, 12 aa, Artificial Sequence
  Description of Artificial Sequence: Synthetic peptide
RASQSVRSTSIA

SEQ ID NO: 2475 - protein, 7 aa, Artificial Sequence
  Description of Artificial Sequence: Synthetic peptide
AASTRAT

SEQ ID NO: 2476 - protein, 25 aa, Artificial Sequence
  Description of Artificial Sequence: Synthetic peptide
CATQSTNDEYDGLLGDDSYYFMDVW

SEQ ID NO: 2477 - protein, 10 aa, Artificial Sequence
  Description of Artificial Sequence: Synthetic peptide
CQQYGTTHTF

SEQ ID NO: 2478 - protein, 9 aa, Artificial Sequence
  Description of Artificial Sequence: Synthetic peptide
GIFSNFGVS

SEQ ID NO: 2479 - protein, 13 aa, Artificial Sequence
  Description of Artificial Sequence: Synthetic peptide
GGIFPLGGIPSYA

SEQ ID NO: 2480 - protein, 12 aa, Artificial Sequence
  Description of Artificial Sequence: Synthetic peptide
RASQSFSDVYLA

SEQ ID NO: 2481 - protein, 7 aa, Artificial Sequence
  Description of Artificial Sequence: Synthetic peptide
ATSSRAP

SEQ ID NO: 2482 - protein, 25 aa, Artificial Sequence
  Description of Artificial Sequence: Synthetic peptide
CAVAFNNDYLRGNYRSPGRSWLESW

SEQ ID NO: 2483 - protein, 10 aa, Artificial Sequence [sequence omitted]

SEQ ID NO: 2484 - protein, 13 aa, Artificial Sequence
  Description of Artificial Sequence: Synthetic peptide
GGIIPIFGSADYA

SEQ ID NO: 2485 - protein, 12 aa, Artificial Sequence
  Description of Artificial Sequence: Synthetic peptide
RASQSISSTSLA

SEQ ID NO: 2486 - protein, 27 aa, Artificial Sequence
  Description of Artificial Sequence: Synthetic peptide
CAGGKHHRRIVVENAISYDYYYGMDVW

SEQ ID NO: 2487 - protein, 12 aa, Artificial Sequence [sequence omitted]

SEQ ID NO: 2488 - protein, 9 aa, Artificial Sequence
  Description of Artificial Sequence: Synthetic peptide
GLFYSYGIN

SEQ ID NO: 2489 - protein, 13 aa, Artificial Sequence
  Description of Artificial Sequence: Synthetic peptide
GGIIPFLGPANYA

SEQ ID NO: 2490 - protein, 16 aa, Artificial Sequence
  Description of Artificial Sequence: Synthetic peptide
RSSQSLQHSNGNNYLD

SEQ ID NO: 2491 - protein, 7 aa, Artificial Sequence
  Description of Artificial Sequence: Synthetic peptide
LGSNRAS

SEQ ID NO: 2492 - protein, 26 aa, Artificial Sequence
  Description of Artificial Sequence: Synthetic peptide
CARDRGQYSYVWGSYRYLEYYGMDVW

SEQ ID NO: 2493 - protein, 12 aa, Artificial Sequence [sequence omitted]

SEQ ID NO: 2494 - protein, 9 aa, Artificial Sequence
  Description of Artificial Sequence: Synthetic peptide
GTFSTYGIN

SEQ ID NO: 2495 - protein, 13 aa, Artificial Sequence
  Description of Artificial Sequence: Synthetic peptide
GGIIPLFNITIHA

SEQ ID NO: 2496 - protein, 16 aa, Artificial Sequence
  Description of Artificial Sequence: Synthetic peptide
RSSQSLLHSNGNNYLD

SEQ ID NO: 2497 - protein, 26 aa, Artificial Sequence
  Description of Artificial Sequence: Synthetic peptide
CARDRSVRGVVSEVSPPHFHHGMDVW

SEQ ID NO: 2498 - protein, 11 aa, Artificial Sequence [sequence omitted]

SEQ ID NO: 2499 - protein, 9 aa, Artificial Sequence
  Description of Artificial Sequence: Synthetic peptide
ASFQSYTIN

SEQ ID NO: 2500 - protein, 13 aa, Artificial Sequence
  Description of Artificial Sequence: Synthetic peptide
GRITPLLGSIHLA

SEQ ID NO: 2501 - protein, 16 aa, Artificial Sequence
  Description of Artificial Sequence: Synthetic peptide
RSSQSLRHSNGHHYVD

SEQ ID NO: 2502 - protein, 7 aa, Artificial Sequence
  Description of Artificial Sequence: Synthetic peptide
SASNRAS

SEQ ID NO: 2503 - protein, 32 aa, Artificial Sequence
  Description of Artificial Sequence: Synthetic polypeptide
CARWSRWKQAGATSVGAKPPGNQRFYYGMDVW

SEQ ID NO: 2504 - protein, 11 aa, Artificial Sequence
  Description of Artificial Sequence: Synthetic peptide
CMQALQPAHTF

SEQ ID NO: 2505 - protein, 9 aa, Artificial Sequence
  Description of Artificial Sequence: Synthetic peptide
GTFSTYSLS

SEQ ID NO: 2506 - protein, 13 aa, Artificial Sequence
  Description of Artificial Sequence: Synthetic peptide
GMVIPALRITNLA

SEQ ID NO: 2507 - protein, 16 aa, Artificial Sequence
  Description of Artificial Sequence: Synthetic peptide
KSSQSLLDSNGYNYLD

SEQ ID NO: 2508 - protein, 29 aa, Artificial Sequence
  Description of Artificial Sequence: Synthetic peptide
CASAVVIDIPGKPGKSRGNFGFYYGLDVW

SEQ ID NO: 2509 - protein, 12 aa, Artificial Sequence [sequence omitted]

SEQ ID NO: 2510 - protein, 9 aa, Artificial Sequence
  Description of Artificial Sequence: Synthetic peptide
GTFSNYAIT

SEQ ID NO: 2511 - protein, 13 aa, Artificial Sequence
  Description of Artificial Sequence: Synthetic peptide
GGIIPLFDVTKSS

SEQ ID NO: 2512 - protein, 16 aa, Artificial Sequence
  Description of Artificial Sequence: Synthetic peptide
RSSQSLLHSSGYNHLD

SEQ ID NO: 2513 - protein, 7 aa, Artificial Sequence
  Description of Artificial Sequence: Synthetic peptide
LASNRAS

SEQ ID NO: 2514 - protein, 29 aa, Artificial Sequence
  Description of Artificial Sequence: Synthetic peptide
CASAVVIEIPGKPGKTRGNFGYYYGLDVW

SEQ ID NO: 2515 - protein, 12 aa, Artificial Sequence [sequence omitted]

SEQ ID NO: 2516 - protein, 9 aa, Artificial Sequence
  Description of Artificial Sequence: Synthetic peptide
GTFTNYGIS

SEQ ID NO: 2517 - protein, 13 aa, Artificial Sequence
  Description of Artificial Sequence: Synthetic peptide
GAIIPLFDTIRSA

SEQ ID NO: 2518 - protein, 16 aa, Artificial Sequence
  Description of Artificial Sequence: Synthetic peptide
RSSQSLLHSSGYNYLD

SEQ ID NO: 2519 - protein, 25 aa, Artificial Sequence
  Description of Artificial Sequence: Synthetic peptide
CASLPDSSDWYVSSPGGEYYGLDVW

SEQ ID NO: 2520 - protein, 11 aa, Artificial Sequence [sequence omitted]

SEQ ID NO: 2521 - protein, 13 aa, Artificial Sequence
  Description of Artificial Sequence: Synthetic peptide
GGIIPVFGTVHYA

SEQ ID NO: 2522 - protein, 16 aa, Artificial Sequence
  Description of Artificial Sequence: Synthetic peptide
RSSQSLLHSNGYNYLD

SEQ ID NO: 2523 - protein, 26 aa, Artificial Sequence
  Description of Artificial Sequence: Synthetic peptide
CAGGIWAGELYPSLPGYYYNYGMDVW

SEQ ID NO: 2524 - protein, 11 aa, Artificial Sequence [sequence omitted]

SEQ ID NO: 2525 - protein, 9 aa, Artificial Sequence
  Description of Artificial Sequence: Synthetic peptide
DTFSRYSII

SEQ ID NO: 2526 - protein, 13 aa, Artificial Sequence
  Description of Artificial Sequence: Synthetic peptide
GGIIPMSATANYA

SEQ ID NO: 2527 - protein, 17 aa, Artificial Sequence
  Description of Artificial Sequence: Synthetic peptide
KSSQTILYSLNNKNYLA

SEQ ID NO: 2528 - protein, 7 aa, Artificial Sequence
  Description of Artificial Sequence: Synthetic peptide
WASTRGS

SEQ ID NO: 2529 - protein, 25 aa, Artificial Sequence
  Description of Artificial Sequence: Synthetic peptide
CARDSHDLTLVGGVIDYHYYGMDVW

SEQ ID NO: 2530 - protein, 11 aa, Artificial Sequence [sequence omitted]

SEQ ID NO: 2531 - protein, 9 aa, Artificial Sequence
  Description of Artificial Sequence: Synthetic peptide
GTFSTYVIT

SEQ ID NO: 2532 - protein, 13 aa, Artificial Sequence
  Description of Artificial Sequence: Synthetic peptide
GRVIPTLDKADYA

SEQ ID NO: 2533 - protein, 17 aa, Artificial Sequence
  Description of Artificial Sequence: Synthetic peptide
KSSQSILHSSSSKSYLT

SEQ ID NO: 2534 - protein, 7 aa, Artificial Sequence
  Description of Artificial Sequence: Synthetic peptide
WASTRES

SEQ ID NO: 2535 - protein, 27 aa, Artificial Sequence
  Description of Artificial Sequence: Synthetic peptide
CARERTDTSGDIGDSNLYYYYYGMDVW

SEQ ID NO: 2536 - protein, 11 aa, Artificial Sequence [sequence omitted]

SEQ ID NO: 2537 - protein, 9 aa, Artificial Sequence
  Description of Artificial Sequence: Synthetic peptide
DTFSRHAIS

SEQ ID NO: 2538 - protein, 13 aa, Artificial Sequence
  Description of Artificial Sequence: Synthetic peptide
GGIIPIYDAANYA

SEQ ID NO: 2539 - protein, 17 aa, Artificial Sequence
  Description of Artificial Sequence: Synthetic peptide
KASQSVLHSSNHKNYLG

SEQ ID NO: 2540 - protein, 28 aa, Artificial Sequence
  Description of Artificial Sequence: Synthetic peptide
CARGEDLKKDSSGHYYWDRIPYSYFDSW

SEQ ID NO: 2541 - protein, 11 aa, Artificial Sequence [sequence omitted]

SEQ ID NO: 2542 - protein, 9 aa, Artificial Sequence
  Description of Artificial Sequence: Synthetic peptide
GTFNTYAIS

SEQ ID NO: 2543 - protein, 13 aa, Artificial Sequence
  Description of Artificial Sequence: Synthetic peptide
GGILPIFGKPDYA

SEQ ID NO: 2544 - protein, 17 aa, Artificial Sequence
  Description of Artificial Sequence: Synthetic peptide
KSSQSLFYSSNNKTYLA

SEQ ID NO: 2545 - protein, 27 aa, Artificial Sequence
  Description of Artificial Sequence: Synthetic peptide
CARGGFSPRITMVREIISYYYYYMDVW

SEQ ID NO: 2546 - protein, 10 aa, Artificial Sequence [sequence omitted]

SEQ ID NO: 2547 - protein, 9 aa, Artificial Sequence
  Description of Artificial Sequence: Synthetic peptide
GTFSGHAIS

SEQ ID NO: 2548 - protein, 13 aa, Artificial Sequence
  Description of Artificial Sequence: Synthetic peptide
GGIIPLFDTSNYA

SEQ ID NO: 2549 - protein, 17 aa, Artificial Sequence
  Description of Artificial Sequence: Synthetic peptide
KSSQSVLYSSNNKNYLA

SEQ ID NO: 2550 - protein, 26 aa, Artificial Sequence
  Description of Artificial Sequence: Synthetic peptide
CAKAMGCSGTTCSVSWGYYFYALDVW

SEQ ID NO: 2551 - protein, 11 aa, Artificial Sequence [sequence omitted]

SEQ ID NO: 2552 - protein, 9 aa, Artificial Sequence
  Description of Artificial Sequence: Synthetic peptide
FTLSGYGMH

SEQ ID NO: 2553 - protein, 13 aa, Artificial Sequence
  Description of Artificial Sequence: Synthetic peptide
AVISPNGSNKYYA

SEQ ID NO: 2554 - protein, 16 aa, Artificial Sequence
  Description of Artificial Sequence: Synthetic peptide
RSSQSLLYANRYNYLD

SEQ ID NO: 2555 - protein, 27 aa, Artificial Sequence
  Description of Artificial Sequence: Synthetic peptide
CAKDRAREDLRFLDWPSTPPHYDMDVW

SEQ ID NO: 2556 - protein, 11 aa, Artificial Sequence [sequence omitted]

SEQ ID NO: 2557 - protein, 9 aa, Artificial Sequence
  Description of Artificial Sequence: Synthetic peptide
FSFKNFAMH

SEQ ID NO: 2558 - protein, 13 aa, Artificial Sequence
  Description of Artificial Sequence: Synthetic peptide
SLISYDGKKKSYV

SEQ ID NO: 2559 - protein, 16 aa, Artificial Sequence
  Description of Artificial Sequence: Synthetic peptide
RSSQSLLESNGYNYLN

SEQ ID NO: 2560 - protein, 30 aa, Artificial Sequence
  Description of Artificial Sequence: Synthetic polypeptide
CAKGEENLVLSPAKIYPRKSASIHYALDVW

SEQ ID NO: 2561 - protein, 9 aa, Artificial Sequence
  Description of Artificial Sequence: Synthetic peptide
VTFSGFGLH

SEQ ID NO: 2562 - protein, 13 aa, Artificial Sequence
  Description of Artificial Sequence: Synthetic peptide
ALISNDGNIKHFA

SEQ ID NO: 2563 - protein, 7 aa, Artificial Sequence
  Description of Artificial Sequence: Synthetic peptide
LGSTRAS

SEQ ID NO: 2564 - protein, 30 aa, Artificial Sequence
  Description of Artificial Sequence: Synthetic polypeptide
CAKGEHLVVLSPAKIYPRKSASIHYALDVW

SEQ ID NO: 2565 - protein, 9 aa, Artificial Sequence
  Description of Artificial Sequence: Synthetic peptide
VSFSAYGLH

SEQ ID NO: 2566 - protein, 13 aa, Artificial Sequence
  Description of Artificial Sequence: Synthetic peptide
ALISSDGSFTQYG

SEQ ID NO: 2567 - protein, 16 aa, Artificial Sequence
  Description of Artificial Sequence: Synthetic peptide
RSSQSLLHSNGYNYVD

SEQ ID NO: 2568 - protein, 25 aa, Artificial Sequence
  Description of Artificial Sequence: Synthetic peptide
CAKGGDCSSASCNAGVYYYYGMDVW

SEQ ID NO: 2569 - protein, 10 aa, Artificial Sequence
  Description of Artificial Sequence: Synthetic peptide
CMQTLEIPTF

SEQ ID NO: 2570 - protein, 9 aa, Artificial Sequence
  Description of Artificial Sequence: Synthetic peptide
FSVSSYAMN

SEQ ID NO: 2571 - protein, 13 aa, Artificial Sequence
  Description of Artificial Sequence: Synthetic peptide
SVISYDGRSEHYV

SEQ ID NO: 2572 - protein, 16 aa, Artificial Sequence
  Description of Artificial Sequence: Synthetic peptide
RSSQSLLSRNKYIYLD

SEQ ID NO: 2573 - protein, 7 aa, Artificial Sequence
  Description of Artificial Sequence: Synthetic peptide
FGSNRAS

SEQ ID NO: 2574 - protein, 26 aa, Artificial Sequence
  Description of Artificial Sequence: Synthetic peptide
CARALGCGGTSCSVSWGYYYYALEVW

SEQ ID NO: 2575 - protein, 11 aa, Artificial Sequence [sequence omitted]

SEQ ID NO: 2576 - protein, 13 aa, Artificial Sequence
  Description of Artificial Sequence: Synthetic peptide
AVISPNGNNKYYA

SEQ ID NO: 2577 - protein, 16 aa, Artificial Sequence
  Description of Artificial Sequence: Synthetic peptide
RSSQSLLYRNRYNYLD

SEQ ID NO: 2578 - protein, 25 aa, Artificial Sequence
  Description of Artificial Sequence: Synthetic peptide
CARGSRMAHCLSTSCSHYYYGMDVW

SEQ ID NO: 2579 - protein, 11 aa, Artificial Sequence
  Description of Artificial Sequence: Synthetic peptide
CMQTLETPLIF

SEQ ID NO: 2580 - protein, 9 aa, Artificial Sequence
  Description of Artificial Sequence: Synthetic peptide
FMFNMYGIH

SEQ ID NO: 2581 - protein, 13 aa, Artificial Sequence
  Description of Artificial Sequence: Synthetic peptide
ALISHDGNNKYYA

SEQ ID NO: 2582 - protein, 26 aa, Artificial Sequence
  Description of Artificial Sequence: Synthetic peptide
CGRGIGGQCNSPTCYPPGGYYGLEVW

SEQ ID NO: 2583 - protein, 11 aa, Artificial Sequence [sequence omitted]

SEQ ID NO: 2584 - protein, 9 aa, Artificial Sequence
  Description of Artificial Sequence: Synthetic peptide
FTFSNYPMH

SEQ ID NO: 2585 - protein, 13 aa, Artificial Sequence
  Description of Artificial Sequence: Synthetic peptide
AVISYDGNIKYYA

SEQ ID NO: 2586 - protein, 25 aa, Artificial Sequence
  Description of Artificial Sequence: Synthetic peptide
CAKDLGVQDYGFWSGYNYFYGMDVW

SEQ ID NO: 2587 - protein, 13 aa, Artificial Sequence [sequence omitted]

SEQ ID NO: 2588 - protein, 9 aa, Artificial Sequence
  Description of Artificial Sequence: Synthetic peptide
FAFSTYAMH

SEQ ID NO: 2589 - protein, 13 aa, Artificial Sequence
  Description of Artificial Sequence: Synthetic peptide
TLTSYDGSEKYYG

SEQ ID NO: 2590 - protein, 14 aa, Artificial Sequence
  Description of Artificial Sequence: Synthetic peptide
TGTSSDVGGSNFVS

SEQ ID NO: 2591 - protein, 7 aa, Artificial Sequence
  Description of Artificial Sequence: Synthetic peptide
EVTNRPS

SEQ ID NO: 2592 - protein, 34 aa, Artificial Sequence
  Description of Artificial Sequence: Synthetic polypeptide
CARALPSPKKIKVGVPSLFTTTTTVVYYYIMDVW

SEQ ID NO: 2593 - protein, 13 aa, Artificial Sequence
  Description of Artificial Sequence: Synthetic peptide
CNSYIGSRNLVIF

SEQ ID NO: 2594 - protein, 9 aa, Artificial Sequence
  Description of Artificial Sequence: Synthetic peptide
FTFSSYTFY

SEQ ID NO: 2595 - protein, 13 aa, Artificial Sequence
  Description of Artificial Sequence: Synthetic peptide
ADISDDGTNKYYA

SEQ ID NO: 2596 - protein, 14 aa, Artificial Sequence
  Description of Artificial Sequence: Synthetic peptide
TGISSDVGDYSCVS

SEQ ID NO: 2597 - protein, 7 aa, Artificial Sequence
  Description of Artificial Sequence: Synthetic peptide
DVTNRPS

SEQ ID NO: 2598 - protein, 28 aa, Artificial Sequence
  Description of Artificial Sequence: Synthetic peptide
CARDFKTIEYYDMLSGSSIHYHYLMDVW

SEQ ID NO: 2599 - protein, 12 aa, Artificial Sequence
  Description of Artificial Sequence: Synthetic peptide
CSSYKDTNSLVF

SEQ ID NO: 2600 - protein, 9 aa, Artificial Sequence
  Description of Artificial Sequence: Synthetic peptide
FTFSDYALH

SEQ ID NO: 2601 - protein, 13 aa, Artificial Sequence
  Description of Artificial Sequence: Synthetic peptide
AVISYDGAYEYYA

SEQ ID NO: 2602 - protein, 14 aa, Artificial Sequence
  Description of Artificial Sequence: Synthetic peptide
SGSSSDIGGYNYVS

SEQ ID NO: 2603 - protein, 7 aa, Artificial Sequence
  Description of Artificial Sequence: Synthetic peptide
DVRDRPS

SEQ ID NO: 2604 - protein, 26 aa, Artificial Sequence
  Description of Artificial Sequence: Synthetic peptide
CARDHPSITLIVVVFHTATGYAMDAW

SEQ ID NO: 2605 - protein, 12 aa, Artificial Sequence
  Description of Artificial Sequence: Synthetic peptide
CASYTTSSTLLF

SEQ ID NO: 2606 - protein, 9 aa, Artificial Sequence
  Description of Artificial Sequence: Synthetic peptide
FTFSEHAIH

SEQ ID NO: 2607 - protein, 13 aa, Artificial Sequence
  Description of Artificial Sequence: Synthetic peptide
AVISNNGINKYYA

SEQ ID NO: 2608 - protein, 14 aa, Artificial Sequence
  Description of Artificial Sequence: Synthetic peptide
TGTSSDIGGYKYVS

SEQ ID NO: 2609 - protein, 7 aa, Artificial Sequence
  Description of Artificial Sequence: Synthetic peptide
EVSNRPA

SEQ ID NO: 2610 - protein, 26 aa, Artificial Sequence
  Description of Artificial Sequence: Synthetic peptide
CARDHPSLTLIVVVFHTATGYTLDVW

SEQ ID NO: 2611 - protein, 12 aa, Artificial Sequence [sequence omitted]

SEQ ID NO: 2612 - protein, 9 aa, Artificial Sequence
  Description of Artificial Sequence: Synthetic peptide
FSFKEYAMH

SEQ ID NO: 2613 - protein, 13 aa, Artificial Sequence
  Description of Artificial Sequence: Synthetic peptide
AVISNTGINKYYA

SEQ ID NO: 2614 - protein, 14 aa, Artificial Sequence
  Description of Artificial Sequence: Synthetic peptide
TGTSGDVGAYNYVS

SEQ ID NO: 2615 - protein, 7 aa, Artificial Sequence
  Description of Artificial Sequence: Synthetic peptide
EVSNRPS

SEQ ID NO: 2616 - protein, 32 aa, Artificial Sequence
  Description of Artificial Sequence: Synthetic polypeptide
CARGDTAYCTSTNCVTGDDFWIGYYPGALDYW

SEQ ID NO: 2617 - protein, 15 aa, Artificial Sequence
  Description of Artificial Sequence: Synthetic peptide
CTSCTSCTTTSTVVF

SEQ ID NO: 2618 - protein, 9 aa, Artificial Sequence
  Description of Artificial Sequence: Synthetic peptide
FTFKNYGVH

SEQ ID NO: 2619 - protein, 13 aa, Artificial Sequence
  Description of Artificial Sequence: Synthetic peptide
GVIWYDGRNTHYA

SEQ ID NO: 2620 - protein, 14 aa, Artificial Sequence
  Description of Artificial Sequence: Synthetic peptide
TGTSSDVGGYDYVS

SEQ ID NO: 2621 - protein, 26 aa, Artificial Sequence
  Description of Artificial Sequence: Synthetic peptide
CARYDCRGGTCYGNWRDYYYFAMDVW

SEQ ID NO: 2622 - protein, 12 aa, Artificial Sequence
  Description of Artificial Sequence: Synthetic peptide
CHSYTGPNTLEF

SEQ ID NO: 2623 - protein, 9 aa, Artificial Sequence
  Description of Artificial Sequence: Synthetic peptide
FTLTKHSMH

SEQ ID NO: 2624 - protein, 12 aa, Artificial Sequence
  Description of Artificial Sequence: Synthetic peptide
ATISYHGSHEYV

SEQ ID NO: 2625 - protein, 14 aa, Artificial Sequence
  Description of Artificial Sequence: Synthetic peptide
TGAIRDVGGNNYVS

SEQ ID NO: 2626 - protein, 7 aa, Artificial Sequence
  Description of Artificial Sequence: Synthetic peptide
EVDNRPS

SEQ ID NO: 2627 - protein, 25 aa, Artificial Sequence
  Description of Artificial Sequence: Synthetic peptide
CAKDNQYYDMWSSFYTYFYHYMDVW

SEQ ID NO: 2628 - protein, 11 aa, Artificial Sequence
  Description of Artificial Sequence: Synthetic peptide
CQYYGGAPYIF

SEQ ID NO: 2629 - protein, 9 aa, Artificial Sequence
  Description of Artificial Sequence: Synthetic peptide
FSFSSYGIH

SEQ ID NO: 2630 - protein, 13 aa, Artificial Sequence
  Description of Artificial Sequence: Synthetic peptide
AVISYDGKNKNYA

SEQ ID NO: 2631 - protein, 12 aa, Artificial Sequence
  Description of Artificial Sequence: Synthetic peptide
RASQTLATTSLA

SEQ ID NO: 2632 - protein, 27 aa, Artificial Sequence
  Description of Artificial Sequence: Synthetic peptide
CARDAPYCSGGSCYELRDYYFYGMDVW

SEQ ID NO: 2633 - protein, 11 aa, Artificial Sequence [sequence omitted]

SEQ ID NO: 2634 - protein, 9 aa, Artificial Sequence
  Description of Artificial Sequence: Synthetic peptide
FTFNNSGMH

SEQ ID NO: 2635 - protein, 13 aa, Artificial Sequence
  Description of Artificial Sequence: Synthetic peptide
AVIWYDGSYTDYV

SEQ ID NO: 2636 - protein, 12 aa, Artificial Sequence
  Description of Artificial Sequence: Synthetic peptide
RASQSVGRTSLA

SEQ ID NO: 2637 - protein, 7 aa, Artificial Sequence
  Description of Artificial Sequence: Synthetic peptide
GTSNRAT

SEQ ID NO: 2638 - protein, 29 aa, Artificial Sequence
  Description of Artificial Sequence: Synthetic peptide
CARDLSWESDNFWSALVRKQEDYSGLDVW

SEQ ID NO: 2639 - protein, 12 aa, Artificial Sequence
  Description of Artificial Sequence: Synthetic peptide
CQHYGSSPLFIF

SEQ ID NO: 2640 - protein, 9 aa, Artificial Sequence
  Description of Artificial Sequence: Synthetic peptide
FTFSRYGMN

SEQ ID NO: 2641 - protein, 13 aa, Artificial Sequence
  Description of Artificial Sequence: Synthetic peptide
AVVWFDGSNKYYA

SEQ ID NO: 2642 - protein, 12 aa, Artificial Sequence
  Description of Artificial Sequence: Synthetic peptide
RTSQSVSSSYVA

SEQ ID NO: 2643 - protein, 7 aa, Artificial Sequence
  Description of Artificial Sequence: Synthetic peptide
AASRRAT

SEQ ID NO: 2644 - protein, 26 aa, Artificial Sequence
  Description of Artificial Sequence: Synthetic peptide
CARDVGRIGSFALFGMVVATNYFDFW

SEQ ID NO: 2645 - protein, 11 aa, Artificial Sequence [sequence omitted]

SEQ ID NO: 2646 - protein, 9 aa, Artificial Sequence
  Description of Artificial Sequence: Synthetic peptide
FIFSGHAMH

SEQ ID NO: 2647 - protein, 13 aa, Artificial Sequence
  Description of Artificial Sequence: Synthetic peptide
SMISDNGINKLYS

SEQ ID NO: 2648 - protein, 12 aa, Artificial Sequence
  Description of Artificial Sequence: Synthetic peptide
RASQSVTNNYLA

SEQ ID NO: 2649 - protein, 7 aa, Artificial Sequence
  Description of Artificial Sequence: Synthetic peptide
GVSSRAA

SEQ ID NO: 2650 - protein, 25 aa, Artificial Sequence
  Description of Artificial Sequence: Synthetic peptide
CAREETSRIAAIGGVTHYYYGMDVW

SEQ ID NO: 2651 - protein, 11 aa, Artificial Sequence [sequence omitted]

SEQ ID NO: 2652 - protein, 9 aa, Artificial Sequence
  Description of Artificial Sequence: Synthetic peptide
FTFGSYAMN

SEQ ID NO: 2653 - protein, 13 aa, Artificial Sequence
  Description of Artificial Sequence: Synthetic peptide
ALIEYDGSNKYYT

SEQ ID NO: 2654 - protein, 12 aa, Artificial Sequence
  Description of Artificial Sequence: Synthetic peptide
RASQSVASTYLA

SEQ ID NO: 2655 - protein, 25 aa, Artificial Sequence
  Description of Artificial Sequence: Synthetic peptide
CARGAPGGHTAMVGYFYYYYGMDVW

SEQ ID NO: 2656 - protein, 13 aa, Artificial Sequence
  Description of Artificial Sequence: Synthetic peptide
CQQYGNSPPVYTF

SEQ ID NO: 2657 - protein, 9 aa, Artificial Sequence
  Description of Artificial Sequence: Synthetic peptide
FTFSSYAMH

SEQ ID NO: 2658 - protein, 13 aa, Artificial Sequence
  Description of Artificial Sequence: Synthetic peptide
AVISYDGSNKYYA

SEQ ID NO: 2659 - protein, 27 aa, Artificial Sequence
  Description of Artificial Sequence: Synthetic peptide
CAKAVYFEYSSGWSSLTQYYYYGMDVW

SEQ ID NO: 2660 - protein, 11 aa, Artificial Sequence [sequence omitted]

SEQ ID NO: 2661 - protein, 9 aa, Artificial Sequence
  Description of Artificial Sequence: Synthetic peptide
FTFSSYGMH

SEQ ID NO: 2662 - protein, 11 aa, Artificial Sequence
  Description of Artificial Sequence: Synthetic peptide
SGDKLGDKYAC

SEQ ID NO: 2663 - protein, 7 aa, Artificial Sequence
  Description of Artificial Sequence: Synthetic peptide
QDNKRPS

SEQ ID NO: 2664 - protein, 25 aa, Artificial Sequence
  Description of Artificial Sequence: Synthetic peptide
CAKDAAGYGDHDYDDFEKDFGMDVW

SEQ ID NO: 2665 - protein, 11 aa, Artificial Sequence
  Description of Artificial Sequence: Synthetic peptide
CQAWDTRIVVF

SEQ ID NO: 2666 - protein, 9 aa, Artificial Sequence
  Description of Artificial Sequence: Synthetic peptide
FTLSNYGTH

SEQ ID NO: 2667 - protein, 13 aa, Artificial Sequence
  Description of Artificial Sequence: Synthetic peptide
ASISFDGSNTYYA

SEQ ID NO: 2668 - protein, 11 aa, Artificial Sequence
  Description of Artificial Sequence: Synthetic peptide
SADNLRHRYVF

SEQ ID NO: 2669 - protein, 7 aa, Artificial Sequence
  Description of Artificial Sequence: Synthetic peptide
QNDRRPS

SEQ ID NO: 2670 - protein, 25 aa, Artificial Sequence
  Description of Artificial Sequence: Synthetic peptide
CAKDQLGYCTSTSCYREYYYGMDVW

SEQ ID NO: 2671 - protein, 10 aa, Artificial Sequence [sequence omitted]

SEQ ID NO: 2672 - protein, 9 aa, Artificial Sequence
  Description of Artificial Sequence: Synthetic peptide
LTFSSYGMH

SEQ ID NO: 2673 - protein, 11 aa, Artificial Sequence
  Description of Artificial Sequence: Synthetic peptide
SGDKLGDKYVC

SEQ ID NO: 2674 - protein, 7 aa, Artificial Sequence
  Description of Artificial Sequence: Synthetic peptide
QNTKRPS

SEQ ID NO: 2675 - protein, 25 aa, Artificial Sequence
  Description of Artificial Sequence: Synthetic peptide
CAKDVRDSIQLWLNLFNYYSGMDVW

SEQ ID NO: 2676 - protein, 14 aa, Artificial Sequence
  Description of Artificial Sequence: Synthetic peptide
CDSRDSSGDPHVLF

SEQ ID NO: 2677 - protein, 9 aa, Artificial Sequence
  Description of Artificial Sequence: Synthetic peptide
FTFINYDMH

SEQ ID NO: 2678 - protein, 13 aa, Artificial Sequence
  Description of Artificial Sequence: Synthetic peptide
AVISYDGSKKYYV

SEQ ID NO: 2679 - protein, 11 aa, Artificial Sequence
  Description of Artificial Sequence: Synthetic peptide
QGDSLRIYYAS

SEQ ID NO: 2680 - protein, 7 aa, Artificial Sequence
  Description of Artificial Sequence: Synthetic peptide
GKNNRPS

SEQ ID NO: 2681 - protein, 25 aa, Artificial Sequence
  Description of Artificial Sequence: Synthetic peptide
CARDESLDGLMITFGGIIVTALDVW

SEQ ID NO: 2682 - protein, 13 aa, Artificial Sequence
  Description of Artificial Sequence: Synthetic peptide
CSSPDSSGYHYVF

SEQ ID NO: 2683 - protein, 9 aa, Artificial Sequence
  Description of Artificial Sequence: Synthetic peptide
FTIGGYGFH

SEQ ID NO: 2684 - protein, 13 aa, Artificial Sequence
  Description of Artificial Sequence: Synthetic peptide
ALISDDGSSKSYA

SEQ ID NO: 2685 - protein, 11 aa, Artificial Sequence
  Description of Artificial Sequence: Synthetic peptide
QGDSLRRYYAS

SEQ ID NO: 2686 - protein, 7 aa, Artificial Sequence
  Description of Artificial Sequence: Synthetic peptide
GKHNRPS

SEQ ID NO: 2687 - protein, 25 aa, Artificial Sequence
  Description of Artificial Sequence: Synthetic peptide
CARDPPGGCSSCYKASYYYWGLDVW

SEQ ID NO: 2688 - protein, 11 aa, Artificial Sequence
  Description of Artificial Sequence: Synthetic peptide
CQAWDTTTGVF

SEQ ID NO: 2689 - protein, 9 aa, Artificial Sequence
  Description of Artificial Sequence: Synthetic peptide
FPFSSYVMH

SEQ ID NO: 2690 - protein, 13 aa, Artificial Sequence
  Description of Artificial Sequence: Synthetic peptide
ASISLDGGNTYYA

SEQ ID NO: 2691 - protein, 11 aa, Artificial Sequence
  Description of Artificial Sequence: Synthetic peptide
SGDKLGDKYTC

SEQ ID NO: 2692 - protein, 7 aa, Artificial Sequence
  Description of Artificial Sequence: Synthetic peptide
QDKKRPS

SEQ ID NO: 2693 - protein, 25 aa, Artificial Sequence
  Description of Artificial Sequence: Synthetic peptide
CAREAGYDFSSGYYAHKRTLDFDYW

SEQ ID NO: 2694 - protein, 13 aa, Artificial Sequence
  Description of Artificial Sequence: Synthetic peptide
CCSRYTGGKQGVF

SEQ ID NO: 2695 - protein, 9 aa, Artificial Sequence
  Description of Artificial Sequence: Synthetic peptide
LTFGVYSWH

SEQ ID NO: 2696 - protein, 13 aa, Artificial Sequence
  Description of Artificial Sequence: Synthetic peptide
AVISPDGSTTSYA

SEQ ID NO: 2697 - protein, 11 aa, Artificial Sequence
  Description of Artificial Sequence: Synthetic peptide
QGDSLRGYFAS

SEQ ID NO: 2698 - protein, 7 aa, Artificial Sequence
  Description of Artificial Sequence: Synthetic peptide
GNNNRPS

SEQ ID NO: 2699 - protein, 25 aa, Artificial Sequence
  Description of Artificial Sequence: Synthetic peptide
CARGPNHYDSSGYEGSYHYYGMDVW

SEQ ID NO: 2700 - protein, 12 aa, Artificial Sequence
  Description of Artificial Sequence: Synthetic peptide
CQVWDTRTYVVF

SEQ ID NO: 2701 - protein, 9 aa, Artificial Sequence
  Description of Artificial Sequence: Synthetic peptide
FIFRNYALH

SEQ ID NO: 2702 - protein, 13 aa, Artificial Sequence
  Description of Artificial Sequence: Synthetic peptide
ALISYDGNSENYP

SEQ ID NO: 2703 - protein, 11 aa, Artificial Sequence
  Description of Artificial Sequence: Synthetic peptide
SGDNLGNKYVS

SEQ ID NO: 2704 - protein, 7 aa, Artificial Sequence
  Description of Artificial Sequence: Synthetic peptide
QDTKRPS

SEQ ID NO: 2705 - protein, 26 aa, Artificial Sequence
  Description of Artificial Sequence: Synthetic peptide
CAKVGIAARPGGAIVPQYYYYFIDVW

SEQ ID NO: 2706 - protein, 13 aa, Artificial Sequence
  Description of Artificial Sequence: Synthetic peptide
CGTWDNSLRGVVF

SEQ ID NO: 2707 - protein, 9 aa, Artificial Sequence
  Description of Artificial Sequence: Synthetic peptide
FTFSTYGIH

SEQ ID NO: 2708 - protein, 13 aa, Artificial Sequence
  Description of Artificial Sequence: Synthetic peptide
AAISHDGRNKYYA

SEQ ID NO: 2709 - protein, 13 aa, Artificial Sequence
  Description of Artificial Sequence: Synthetic peptide
SGNSSNIVNNYVC

SEQ ID NO: 2710 - protein, 7 aa, Artificial Sequence
  Description of Artificial Sequence: Synthetic peptide
DNDKRPS

SEQ ID NO: 2711 - protein, 26 aa, Artificial Sequence
  Description of Artificial Sequence: Synthetic peptide
CAKVPYSSGWYDPRSLTYYQNGMDVW

SEQ ID NO: 2712 - protein, 13 aa, Artificial Sequence [sequence omitted]

SEQ ID NO: 2713 - protein, 9 aa, Artificial Sequence
  Description of Artificial Sequence: Synthetic peptide
FTFRKYAMY

SEQ ID NO: 2714 - protein, 13 aa, Artificial Sequence
  Description of Artificial Sequence: Synthetic peptide
AVISYDGNNEYYE

SEQ ID NO: 2715 - protein, 13 aa, Artificial Sequence
  Description of Artificial Sequence: Synthetic peptide
SGSSSNIGNNYVS

SEQ ID NO: 2716 - protein, 7 aa, Artificial Sequence
  Description of Artificial Sequence: Synthetic peptide
DNSKRPS

SEQ ID NO: 2717 - protein, 27 aa, Artificial Sequence
  Description of Artificial Sequence: Synthetic peptide
CARDGGYYSGSVTYHFLDYYYYGMDVW

SEQ ID NO: 2718 - protein, 14 aa, Artificial Sequence [sequence omitted]

SEQ ID NO: 2719 - protein, 13 aa, Artificial Sequence
  Description of Artificial Sequence: Synthetic peptide
AVILHDGSNKYYA

SEQ ID NO: 2720 - protein, 7 aa, Artificial Sequence
  Description of Artificial Sequence: Synthetic peptide
DNNKRPS

SEQ ID NO: 2721 - protein, 29 aa, Artificial Sequence
  Description of Artificial Sequence: Synthetic peptide
CARDLLGVYFVVIPDNPNSIHYYYDMDVW

SEQ ID NO: 2722 - protein, 9 aa, Artificial Sequence
  Description of Artificial Sequence: Synthetic peptide
FTFSSYVMH

SEQ ID NO: 2723 - protein, 13 aa, Artificial Sequence
  Description of Artificial Sequence: Synthetic peptide
AVISYDGTNKNYA

SEQ ID NO: 2724 - protein, 25 aa, Artificial Sequence
  Description of Artificial Sequence: Synthetic peptide
CARHLNYYDSSGFYFPQVYNGMDVW

SEQ ID NO: 2725 - protein, 13 aa, Artificial Sequence [sequence omitted]

SEQ ID NO: 2726 - protein, 9 aa, Artificial Sequence
  Description of Artificial Sequence: Synthetic peptide
FAFSSYGMH

SEQ ID NO: 2727 - protein, 13 aa, Artificial Sequence
  Description of Artificial Sequence: Synthetic peptide
AVIWDDGINKYYA

SEQ ID NO: 2728 - protein, 13 aa, Artificial Sequence
  Description of Artificial Sequence: Synthetic peptide
SGSSSNIGNNYIS

SEQ ID NO: 2729 - protein, 26 aa, Artificial Sequence
  Description of Artificial Sequence: Synthetic peptide
CAKDPVNYGLWSGDYTGGVGDYFDYW

SEQ ID NO: 2730 - protein, 11 aa, Artificial Sequence [sequence omitted]

SEQ ID NO: 2731 - protein, 9 aa, Artificial Sequence
  Description of Artificial Sequence: Synthetic peptide
ITFSNFGIH

SEQ ID NO: 2732 - protein, 13 aa, Artificial Sequence
  Description of Artificial Sequence: Synthetic peptide
AGISYHGVYQYYA

SEQ ID NO: 2733 - protein, 11 aa, Artificial Sequence
  Description of Artificial Sequence: Synthetic peptide
RASQTLNNNLA

SEQ ID NO: 2734 - protein, 7 aa, Artificial Sequence
  Description of Artificial Sequence: Synthetic peptide
GASTRAT

SEQ ID NO: 2735 - protein, 28 aa, Artificial Sequence
  Description of Artificial Sequence: Synthetic peptide
CARDAGVVRGVTNSPRTFRNYYYYMDVW

SEQ ID NO: 2736 - protein, 11 aa, Artificial Sequence [sequence omitted]

SEQ ID NO: 2737 - protein, 9 aa, Artificial Sequence
  Description of Artificial Sequence: Synthetic peptide
FTFSLYGLH

SEQ ID NO: 2738 - protein, 13 aa, Artificial Sequence
  Description of Artificial Sequence: Synthetic peptide
AVISYDGRHKYYA

SEQ ID NO: 2739 - protein, 11 aa, Artificial Sequence
  Description of Artificial Sequence: Synthetic peptide
GASESITTNLA

SEQ ID NO: 2740 - protein, 7 aa, Artificial Sequence
  Description of Artificial Sequence: Synthetic peptide
GSSSRAT

SEQ ID NO: 2741 - protein, 26 aa, Artificial Sequence
  Description of Artificial Sequence: Synthetic peptide
CARDNPPSHILTDKGSYYYYYAMDVW

SEQ ID NO: 2742 - protein, 11 aa, Artificial Sequence [sequence omitted]

SEQ ID NO: 2743 - protein, 9 aa, Artificial Sequence
  Description of Artificial Sequence: Synthetic peptide
FTLNDYAMH

SEQ ID NO: 2744 - protein, 13 aa, Artificial Sequence
  Description of Artificial Sequence: Synthetic peptide
AVISFDGGHQYSA

SEQ ID NO: 2745 - protein, 11 aa, Artificial Sequence
  Description of Artificial Sequence: Synthetic peptide
RASQSVSRNLA

SEQ ID NO: 2746 - protein, 26 aa, Artificial Sequence
  Description of Artificial Sequence: Synthetic peptide
CARDSFPCGVARCFGDPWESKTLDTW

SEQ ID NO: 2747 - protein, 11 aa, Artificial Sequence
  Description of Artificial Sequence: Synthetic peptide
CQQYRSWPRTF

SEQ ID NO: 2748 - protein, 9 aa, Artificial Sequence
  Description of Artificial Sequence: Synthetic peptide
SDFSDYAIH

SEQ ID NO: 2749 - protein, 13 aa, Artificial Sequence
  Description of Artificial Sequence: Synthetic peptide
AVIWYDGSNKYYA

SEQ ID NO: 2750 - protein, 11 aa, Artificial Sequence
  Description of Artificial Sequence: Synthetic peptide
RASQSVNDYLA

SEQ ID NO: 2751 - protein, 7 aa, Artificial Sequence
  Description of Artificial Sequence: Synthetic peptide
GATSRAL

SEQ ID NO: 2752 - protein, 26 aa, Artificial Sequence
  Description of Artificial Sequence: Synthetic peptide
CARDSFSCGSARCFGDPWESKTLDLW

SEQ ID NO: 2753 - protein, 11 aa, Artificial Sequence
  Description of Artificial Sequence: Synthetic peptide
CQQYNWWPRTF

SEQ ID NO: 2754 - protein, 11 aa, Artificial Sequence
  Description of Artificial Sequence: Synthetic peptide
RASQSVSDYLA

SEQ ID NO: 2755 - protein, 7 aa, Artificial Sequence
  Description of Artificial Sequence: Synthetic peptide
GASSRAP

SEQ ID NO: 2756 - protein, 31 aa, Artificial Sequence
  Description of Artificial Sequence: Synthetic polypeptide
CARDNLLDIVVVPAAMEPDANYYYYHGMDVW

SEQ ID NO: 2757 - protein, 12 aa, Artificial Sequence
  Description of Artificial Sequence: Synthetic peptide
CQQSYNTPSLTF

SEQ ID NO: 2758 - protein, 11 aa, Artificial Sequence
  Description of Artificial Sequence: Synthetic peptide
GSINSGSYYWN

SEQ ID NO: 2759 - protein, 12 aa, Artificial Sequence
  Description of Artificial Sequence: Synthetic peptide
GRIYTSGDTNYN

SEQ ID NO: 2760 - protein, 11 aa, Artificial Sequence
  Description of Artificial Sequence: Synthetic peptide
RASQSINNYLN

SEQ ID NO: 2761 - protein, 7 aa, Artificial Sequence
  Description of Artificial Sequence: Synthetic peptide
AASSLQS

SEQ ID NO: 2762 - protein, 28 aa, Artificial Sequence
  Description of Artificial Sequence: Synthetic peptide
CARDSLITDIVVVPADQRYYYYYGMDVW

SEQ ID NO: 2763 - protein, 11 aa, Artificial Sequence [sequence omitted]

SEQ ID NO: 2764 - protein, 9 aa, Artificial Sequence
  Description of Artificial Sequence: Synthetic peptide
GSISSYYWS

SEQ ID NO: 2765 - protein, 12 aa, Artificial Sequence
  Description of Artificial Sequence: Synthetic peptide
GYIYYSGSTNYN

SEQ ID NO: 2766 - protein, 11 aa, Artificial Sequence
  Description of Artificial Sequence: Synthetic peptide
RASQSISSYLN

SEQ ID NO: 2767 - protein, 25 aa, Artificial Sequence
  Description of Artificial Sequence: Synthetic peptide
CARGAKERVVMVRGVIKSDYGLDVW

SEQ ID NO: 2768 - protein, 11 aa, Artificial Sequence [sequence omitted]

SEQ ID NO: 2769 - protein, 9 aa, Artificial Sequence
  Description of Artificial Sequence: Synthetic peptide
ASIRTYFWS

SEQ ID NO: 2770 - protein, 12 aa, Artificial Sequence
  Description of Artificial Sequence: Synthetic peptide
GYIYYGGKTDYN

SEQ ID NO: 2771 - protein, 11 aa, Artificial Sequence
  Description of Artificial Sequence: Synthetic peptide
RASQSVSNYLN

SEQ ID NO: 2772 - protein, 7 aa, Artificial Sequence
  Description of Artificial Sequence: Synthetic peptide
AALSLQS

SEQ ID NO: 2773 - protein, 29 aa, Artificial Sequence
  Description of Artificial Sequence: Synthetic peptide
CARIHYTSGSYLSWAGESIIDYYHGMDVW

SEQ ID NO: 2774 - protein, 11 aa, Artificial Sequence
  Description of Artificial Sequence: Synthetic peptide
CQQSSVLPLTF

SEQ ID NO: 2775 - protein, 11 aa, Artificial Sequence
  Description of Artificial Sequence: Synthetic peptide
GSVTSDSYYWS

SEQ ID NO: 2776 - protein, 12 aa, Artificial Sequence
  Description of Artificial Sequence: Synthetic peptide
GHIYYSGNTNYH

SEQ ID NO: 2777 - protein, 11 aa, Artificial Sequence
  Description of Artificial Sequence: Synthetic peptide
RASESISDYLH

SEQ ID NO: 2778 - protein, 7 aa, Artificial Sequence
  Description of Artificial Sequence: Synthetic peptide
GAYRLQS

SEQ ID NO: 2779 - protein, 26 aa, Artificial Sequence
  Description of Artificial Sequence: Synthetic peptide
CARSWGKLAGELTPYSTSAIGHFDFW

SEQ ID NO: 2780 - protein, 11 aa, Artificial Sequence
  Description of Artificial Sequence: Synthetic peptide
CQQNFSLYVTF

SEQ ID NO: 2781 - protein, 11 aa, Artificial Sequence
  Description of Artificial Sequence: Synthetic peptide
GSVSSGNYFWS

SEQ ID NO: 2782 - protein, 12 aa, Artificial Sequence
  Description of Artificial Sequence: Synthetic peptide
GYIHHTGTTKFN

SEQ ID NO: 2783 - protein, 11 aa, Artificial Sequence
  Description of Artificial Sequence: Synthetic peptide
RSSQKISESLN

SEQ ID NO: 2784 - protein, 7 aa, Artificial Sequence
  Description of Artificial Sequence: Synthetic peptide
GTSNLQR

SEQ ID NO: 2785 - protein, 25 aa, Artificial Sequence
  Description of Artificial Sequence: Synthetic peptide
CARHNIPFWASVTGTVAGTGLIDFW

SEQ ID NO: 2786 - protein, 11 aa, Artificial Sequence
  Description of Artificial Sequence: Synthetic peptide
GSISSNNYFWG

SEQ ID NO: 2787 - protein, 12 aa, Artificial Sequence
  Description of Artificial Sequence: Synthetic peptide
GTIYYTGRTYYN

SEQ ID NO: 2788 - protein, 12 aa, Artificial Sequence
  Description of Artificial Sequence: Synthetic peptide
RASQSVSGSYLA

SEQ ID NO: 2789 - protein, 27 aa, Artificial Sequence
  Description of Artificial Sequence: Synthetic peptide
CARVGYCNSANCPVGVWFGQFYGLDVW

SEQ ID NO: 2790 - protein, 11 aa, Artificial Sequence [sequence omitted]

SEQ ID NO: 2791 - protein, 11 aa, Artificial Sequence
  Description of Artificial Sequence: Synthetic peptide
GSITDNSYYWG

SEQ ID NO: 2792 - protein, 12 aa, Artificial Sequence
  Description of Artificial Sequence: Synthetic peptide
GRINNHGRTYYS

SEQ ID NO: 2793 - protein, 12 aa, Artificial Sequence
  Description of Artificial Sequence: Synthetic peptide
RASQSVNSNSLA

SEQ ID NO: 2794 - protein, 26 aa, Artificial Sequence
  Description of Artificial Sequence: Synthetic peptide
CEKHASAYYDFWSGSYNNNYYGMDVW

SEQ ID NO: 2795 - protein, 12 aa, Artificial Sequence [sequence omitted]

SEQ ID NO: 2796 - protein, 11 aa, Artificial Sequence
  Description of Artificial Sequence: Synthetic peptide
GSISSSNYYWG

SEQ ID NO: 2797 - protein, 12 aa, Artificial Sequence
  Description of Artificial Sequence: Synthetic peptide
GCIYYSGTTYYN

SEQ ID NO: 2798 - protein, 12 aa, Artificial Sequence
  Description of Artificial Sequence: Synthetic peptide
RASQSISSSNLA

SEQ ID NO: 2799 - protein, 25 aa, Artificial Sequence
  Description of Artificial Sequence: Synthetic peptide
CVRHPVGNYDFFSGAQRGQYYFDFW

SEQ ID NO: 2800 - protein, 11 aa, Artificial Sequence
  Description of Artificial Sequence: Synthetic peptide
CQQYSDSPPTF

SEQ ID NO: 2801 - protein, 11 aa, Artificial Sequence
  Description of Artificial Sequence: Synthetic peptide
GSVSSRGYQWG

SEQ ID NO: 2802 - protein, 12 aa, Artificial Sequence
  Description of Artificial Sequence: Synthetic peptide
GTVYYSGNTYYT

SEQ ID NO: 2803 - protein, 12 aa, Artificial Sequence
  Description of Artificial Sequence: Synthetic peptide
RASQRISSSYLA

SEQ ID NO: 2804 - protein, 29 aa, Artificial Sequence
  Description of Artificial Sequence: Synthetic peptide
CVRSRKAGVILGFCSGGVCNYIPGYFDYW

SEQ ID NO: 2805 - protein, 12 aa, Artificial Sequence
  Description of Artificial Sequence: Synthetic peptide
CQHYGTSSRDTF

SEQ ID NO: 2806 - protein, 11 aa, Artificial Sequence
  Description of Artificial Sequence: Synthetic peptide
GSISSPNFHWG

SEQ ID NO: 2807 - protein, 12 aa, Artificial Sequence
  Description of Artificial Sequence: Synthetic peptide
GSVHYNGNTHYN

SEQ ID NO: 2808 - protein, 12 aa, Artificial Sequence
  Description of Artificial Sequence: Synthetic peptide
RASQRVTSRYLA

SEQ ID NO: 2809 - protein, 32 aa, Artificial Sequence
  Description of Artificial Sequence: Synthetic polypeptide
CAKEGFVLTLSGGITLLRGPISAYYDYGMDVW

SEQ ID NO: 2810 - protein, 7 aa, Artificial Sequence
  Description of Artificial Sequence: Synthetic peptide
CQQRRSF

SEQ ID NO: 2811 - protein, 9 aa, Artificial Sequence
  Description of Artificial Sequence: Synthetic peptide
ITFNSYAMG

SEQ ID NO: 2812 - protein, 13 aa, Artificial Sequence
  Description of Artificial Sequence: Synthetic peptide
SSISSPSDSTYYA

SEQ ID NO: 2813 - protein, 11 aa, Artificial Sequence
  Description of Artificial Sequence: Synthetic peptide
RASQSVGSDLA

SEQ ID NO: 2814 - protein, 7 aa, Artificial Sequence
  Description of Artificial Sequence: Synthetic peptide
DASSRAT

SEQ ID NO: 2815 - protein, 25 aa, Artificial Sequence
  Description of Artificial Sequence: Synthetic peptide
CAKNLEKSKIVVVPAANPPHAFDIW

SEQ ID NO: 2816 - protein, 11 aa, Artificial Sequence [sequence omitted]

SEQ ID NO: 2817 - protein, 9 aa, Artificial Sequence
  Description of Artificial Sequence: Synthetic peptide
FTFSSYAMS

SEQ ID NO: 2818 - protein, 13 aa, Artificial Sequence
  Description of Artificial Sequence: Synthetic peptide
SAISGSGGSTYYA

SEQ ID NO: 2819 - protein, 11 aa, Artificial Sequence
  Description of Artificial Sequence: Synthetic peptide
RASQSVSSYLA

SEQ ID NO: 2820 - protein, 7 aa, Artificial Sequence
  Description of Artificial Sequence: Synthetic peptide
DASNRAT

SEQ ID NO: 2821 - protein, 25 aa, Artificial Sequence
  Description of Artificial Sequence: Synthetic peptide
CAKSVSYYSHLSPTDPSNFWYSDLW

SEQ ID NO: 2822 - protein, 9 aa, Artificial Sequence
  Description of Artificial Sequence: Synthetic peptide
CQQRTSWLF

SEQ ID NO: 2823 - protein, 9 aa, Artificial Sequence
  Description of Artificial Sequence: Synthetic peptide
FTFSGYAMS

SEQ ID NO: 2824 - protein, 13 aa, Artificial Sequence
  Description of Artificial Sequence: Synthetic peptide
SGISASGDKAISA

SEQ ID NO: 2825 - protein, 11 aa, Artificial Sequence
  Description of Artificial Sequence: Synthetic peptide
RTSQTINNYLA

SEQ ID NO: 2826 - protein, 7 aa, Artificial Sequence
  Description of Artificial Sequence: Synthetic peptide
DAFNRAT

SEQ ID NO: 2827 - protein, 25 aa, Artificial Sequence
  Description of Artificial Sequence: Synthetic peptide
CARDILGKEMPKVKVYVGYWYFDLW

SEQ ID NO: 2828 - protein, 13 aa, Artificial Sequence
  Description of Artificial Sequence: Synthetic peptide
CQHRNNWPPRVTF

SEQ ID NO: 2829 - protein, 9 aa, Artificial Sequence
  Description of Artificial Sequence: Synthetic peptide
FTFSNHAMY

SEQ ID NO: 2830 - protein, 13 aa, Artificial Sequence
  Description of Artificial Sequence: Synthetic peptide
SAIAGFSSSSYYA

SEQ ID NO: 2831 - protein, 11 aa, Artificial Sequence
  Description of Artificial Sequence: Synthetic peptide
RASQSVGTFLA

SEQ ID NO: 2832 - protein, 26 aa, Artificial Sequence
  Description of Artificial Sequence: Synthetic peptide
CVGWPCCGNEECQQSVWLCGYSLDVW

SEQ ID NO: 2833 - protein, 10 aa, Artificial Sequence [sequence omitted]

SEQ ID NO: 2834 - protein, 9 aa, Artificial Sequence
  Description of Artificial Sequence: Synthetic peptide
ISFNTYVMT

SEQ ID NO: 2835 - protein, 13 aa, Artificial Sequence
  Description of Artificial Sequence: Synthetic peptide
AGVSGGATGTYYA

SEQ ID NO: 2836 - protein, 11 aa, Artificial Sequence
  Description of Artificial Sequence: Synthetic peptide
RASRNIDFHLA

SEQ ID NO: 2837 - protein, 26 aa, Artificial Sequence
  Description of Artificial Sequence: Synthetic peptide
CAKAAGCSGGSCHREWGFYYYAMAVW

SEQ ID NO: 2838 - protein, 9 aa, Artificial Sequence
  Description of Artificial Sequence: Synthetic peptide
FMFGSYAMS

SEQ ID NO: 2839 - protein, 13 aa, Artificial Sequence
  Description of Artificial Sequence: Synthetic peptide
SVISGSGDGTYYA

SEQ ID NO: 2840 - protein, 16 aa, Artificial Sequence
  Description of Artificial Sequence: Synthetic peptide
RSSQSLLYNNEYNYLD

SEQ ID NO: 2841 - protein, 7 aa, Artificial Sequence
  Description of Artificial Sequence: Synthetic peptide
LSSTRAS

SEQ ID NO: 2842 - protein, 29 aa, Artificial Sequence
  Description of Artificial Sequence: Synthetic peptide
CAKGGDYPGYCSSPSCYRHFYYYYGLDVW

SEQ ID NO: 2843 - protein, 11 aa, Artificial Sequence [sequence omitted]

SEQ ID NO: 2844 - protein, 13 aa, Artificial Sequence
  Description of Artificial Sequence: Synthetic peptide
SGISGGGGSTYYA

SEQ ID NO: 2845 - protein, 28 aa, Artificial Sequence
  Description of Artificial Sequence: Synthetic peptide
CAKGSGLMTLIRGPATVNVYGYYGMDVW

SEQ ID NO: 2846 - protein, 11 aa, Artificial Sequence [sequence omitted]

SEQ ID NO: 2847 - protein, 9 aa, Artificial Sequence
  Description of Artificial Sequence: Synthetic peptide
FAFSSDPMS

SEQ ID NO: 2848 - protein, 13 aa, Artificial Sequence
  Description of Artificial Sequence: Synthetic peptide
SVISSSGSSTDYA

SEQ ID NO: 2849 - protein, 7 aa, Artificial Sequence
  Description of Artificial Sequence: Synthetic peptide
LGFNRAS

SEQ ID NO: 2850 - protein, 36 aa, Artificial Sequence
  Description of Artificial Sequence: Synthetic polypeptide
CAKLGATRPNIAVIPVAVDMKKATVKVRGSEATDYW

SEQ ID NO: 2851 - protein, 11 aa, Artificial Sequence [sequence omitted]

SEQ ID NO: 2852 - protein, 9 aa, Artificial Sequence
  Description of Artificial Sequence: Synthetic peptide
FTLTSDAMS

SEQ ID NO: 2853 - protein, 13 aa, Artificial Sequence
  Description of Artificial Sequence: Synthetic peptide
SSISDSGDKTDYA

SEQ ID NO: 2854 - protein, 16 aa, Artificial Sequence
  Description of Artificial Sequence: Synthetic peptide
RSSQSLLHDLGYNYLD

SEQ ID NO: 2855 - protein, 26 aa, Artificial Sequence
  Description of Artificial Sequence: Synthetic peptide
CARSSPVNYCSTTYCHYYYYNGLDVW

SEQ ID NO: 2856 - protein, 11 aa, Artificial Sequence [sequence omitted]

SEQ ID NO: 2857 - protein, 9 aa, Artificial Sequence
  Description of Artificial Sequence: Synthetic peptide
FIFSNYPMS

SEQ ID NO: 2858 - protein, 13 aa, Artificial Sequence
  Description of Artificial Sequence: Synthetic peptide
SAISSNSGTPYYA

SEQ ID NO: 2859 - protein, 16 aa, Artificial Sequence
  Description of Artificial Sequence: Synthetic peptide
RSSQSLLHINEYNYLD

SEQ ID NO: 2860 - protein, 26 aa, Artificial Sequence
  Description of Artificial Sequence: Synthetic peptide
CARDLFTPGRLFSGVVEYVYHGMDVW

SEQ ID NO: 2861 - protein, 11 aa, Artificial Sequence
  Description of Artificial Sequence: Synthetic peptide
CQQFRISPPTF

SEQ ID NO: 2862 - protein, 9 aa, Artificial Sequence
  Description of Artificial Sequence: Synthetic peptide
FSLSNYSLN

SEQ ID NO: 2863 - protein, 13 aa, Artificial Sequence
  Description of Artificial Sequence: Synthetic peptide
SSSSAGRYHIDYA

SEQ ID NO: 2864 - protein, 12 aa, Artificial Sequence
  Description of Artificial Sequence: Synthetic peptide
RASQSVGSTYFA

SEQ ID NO: 2865 - protein, 27 aa, Artificial Sequence
  Description of Artificial Sequence: Synthetic peptide
CARDLKSWYTTSGVRVVPNYDFAMDVW

SEQ ID NO: 2866 - protein, 12 aa, Artificial Sequence
  Description of Artificial Sequence: Synthetic peptide
CQHYDTSLGYTF

SEQ ID NO: 2867 - protein, 9 aa, Artificial Sequence
  Description of Artificial Sequence: Synthetic peptide
FTFNDFSMN

SEQ ID NO: 2868 - protein, 13 aa, Artificial Sequence
  Description of Artificial Sequence: Synthetic peptide
SSISSGSTFIYYA

SEQ ID NO: 2869 - protein, 12 aa, Artificial Sequence
  Description of Artificial Sequence: Synthetic peptide
RASESVSSTYLA

SEQ ID NO: 2870 - protein, 7 aa, Artificial Sequence
  Description of Artificial Sequence: Synthetic peptide
GSSRRAT

SEQ ID NO: 2871 - protein, 26 aa, Artificial Sequence
  Description of Artificial Sequence: Synthetic peptide
CARDNVGHYYDSSGYHAYYYYGMDVW

SEQ ID NO: 2872 - protein, 8 aa, Artificial Sequence [sequence omitted]

SEQ ID NO: 2873 - protein, 9 aa, Artificial Sequence
  Description of Artificial Sequence: Synthetic peptide
FTFSSYSMN

SEQ ID NO: 2874 - protein, 13 aa, Artificial Sequence
  Description of Artificial Sequence: Synthetic peptide
SSISSSSSYIYYA

SEQ ID NO: 2875 - protein, 26 aa, Artificial Sequence
  Description of Artificial Sequence: Synthetic peptide
CARENLFLISGASGLLVRDYNGLDVW

SEQ ID NO: 2876 - protein, 12 aa, Artificial Sequence [sequence omitted]

SEQ ID NO: 2877 - protein, 9 aa, Artificial Sequence
  Description of Artificial Sequence: Synthetic peptide
FIFSSYGMT

SEQ ID NO: 2878 - protein, 13 aa, Artificial Sequence
  Description of Artificial Sequence: Synthetic peptide
SSINDTSTYINYA

SEQ ID NO: 2879 - protein, 12 aa, Artificial Sequence
  Description of Artificial Sequence: Synthetic peptide
RASQSVSRAYLA

SEQ ID NO: 2880 - protein, 25 aa, Artificial Sequence
  Description of Artificial Sequence: Synthetic peptide
CASLFITMVREVIPQGHYYYGMDVW

SEQ ID NO: 2881 - protein, 12 aa, Artificial Sequence [sequence omitted]

SEQ ID NO: 2882 - protein, 25 aa, Artificial Sequence
  Description of Artificial Sequence: Synthetic peptide
CARCPLASIFGVVLMGHGGYYFDHW

SEQ ID NO: 2883 - protein, 11 aa, Artificial Sequence
  Description of Artificial Sequence: Synthetic peptide
CSSYTSNTVVF

SEQ ID NO: 2884 - protein, 11 aa, Artificial Sequence
  Description of Artificial Sequence: Synthetic peptide
DSISNNHYYWG

SEQ ID NO: 2885 - protein, 12 aa, Artificial Sequence
  Description of Artificial Sequence: Synthetic peptide
GSLSSTGSTYHK

SEQ ID NO: 2886 - protein, 14 aa, Artificial Sequence
  Description of Artificial Sequence: Synthetic peptide
TGTSIDLNNYQFVS

SEQ ID NO: 2887 - protein, 7 aa, Artificial Sequence
  Description of Artificial Sequence: Synthetic peptide
EVSSRPS

SEQ ID NO: 2888 - protein, 26 aa, Artificial Sequence
  Description of Artificial Sequence: Synthetic peptide
CARDQLGGDFWSGHNLIYFYYAMDVW

SEQ ID NO: 2889 - protein, 12 aa, Artificial Sequence [sequence omitted]

SEQ ID NO: 2890 - protein, 11 aa, Artificial Sequence
  Description of Artificial Sequence: Synthetic peptide
GSITSTTNFWA

SEQ ID NO: 2891 - protein, 12 aa, Artificial Sequence
  Description of Artificial Sequence: Synthetic peptide
GHIYYDGTTHYN

SEQ ID NO: 2892 - protein, 14 aa, Artificial Sequence
  Description of Artificial Sequence: Synthetic peptide
TGTSSDVGGFNYVS

SEQ ID NO: 2893 - protein, 7 aa, Artificial Sequence
  Description of Artificial Sequence: Synthetic peptide
EVSHRPS

SEQ ID NO: 2894 - protein, 26 aa, Artificial Sequence
  Description of Artificial Sequence: Synthetic peptide
CARRVFGYYYDRSGHYRVVHDAFDIW

SEQ ID NO: 2895 - protein, 12 aa, Artificial Sequence [sequence omitted]

SEQ ID NO: 2896 - protein, 11 aa, Artificial Sequence
  Description of Artificial Sequence: Synthetic peptide
GSISSSSFHWG

SEQ ID NO: 2897 - protein, 12 aa, Artificial Sequence
  Description of Artificial Sequence: Synthetic peptide
GNIFYTGSTYYN

SEQ ID NO: 2898 - protein, 14 aa, Artificial Sequence
  Description of Artificial Sequence: Synthetic peptide
TGTSSDVGGYNYVS

SEQ ID NO: 2899 - protein, 7 aa, Artificial Sequence
  Description of Artificial Sequence: Synthetic peptide
DVSNRPS

SEQ ID NO: 2900 - protein, 25 aa, Artificial Sequence
  Description of Artificial Sequence: Synthetic peptide
CASGHSAYYDFWSGYLELNDAFDIW

SEQ ID NO: 2901 - protein, 13 aa, Artificial Sequence
  Description of Artificial Sequence: Synthetic peptide
CSSYTSASTHVIF

SEQ ID NO: 2902 - protein, 11 aa, Artificial Sequence
  Description of Artificial Sequence: Synthetic peptide
ASISTSSYYWG

SEQ ID NO: 2903 - protein, 12 aa, Artificial Sequence
  Description of Artificial Sequence: Synthetic peptide
GSVYYSGSTYYN

SEQ ID NO: 2904 - protein, 7 aa, Artificial Sequence
  Description of Artificial Sequence: Synthetic peptide
AVNNRPS

SEQ ID NO: 2905 - protein, 40 aa, Artificial Sequence
  Description of Artificial Sequence: Synthetic polypeptide
CARDLRELECEEWTLYNYYDFGSRGPCVDPRGVAGSFDVW

SEQ ID NO: 2906 - protein, 39 aa, Artificial Sequence
  Description of Artificial Sequence: Synthetic polypeptide
CAKDLREDECEEWWSDYYDFGKKLPCRKSRGVAGVFDKW

SEQ ID NO: 2907 - protein, 39 aa, Artificial Sequence
  Description of Artificial Sequence: Synthetic polypeptide
CAKDMREYECEYWTSDYYDFGRPQPCIDRRGVVGIFDMW

SEQ ID NO: 2908 - protein, 39 aa, Artificial Sequence
  Description of Artificial Sequence: Synthetic polypeptide
CAKDLREDECEEWWSDYYDFGKQLPCRKSRGVAGIFDGW

SEQ ID NO: 2909 - protein, 39 aa, Artificial Sequence
  Description of Artificial Sequence: Synthetic polypeptide
CAKDLGESENEEWATDYYDFSIGYPGQDPRGVVGAFDIW

SEQ ID NO: 2910 - protein, 35 aa, Artificial Sequence
  Description of Artificial Sequence: Synthetic polypeptide
CLTGSKHRLRDYFLYNEYGPNYEEWGDYLATLDVW

SEQ ID NO: 2911 - protein, 32 aa, Artificial Sequence
  Description of Artificial Sequence: Synthetic polypeptide
CAREAGGPIWHDDVKYYDFNDGYYNYHYMDVW

SEQ ID NO: 2912 - protein, 32 aa, Artificial Sequence
  Description of Artificial Sequence: Synthetic polypeptide
CVREAGGPDYRNGYNYYDFYDGYYNYHYMDVW

SEQ ID NO: 2913 - protein, 30 aa, Artificial Sequence
  Description of Artificial Sequence: Synthetic polypeptide
CARMFQESGPPRFDSWSGRNYYYYSGMDVW

SEQ ID NO: 2914 - protein, 30 aa, Artificial Sequence
  Description of Artificial Sequence: Synthetic polypeptide
CARMFQESGPPRLDRWSGRNYYYYSGMDVW

SEQ ID NO: 2915 - protein, 29 aa, Artificial Sequence
  Description of Artificial Sequence: Synthetic peptide
CARIDVVITSHEDDFGDYYTGEYYGLDSW

SEQ ID NO: 2916 - protein, 29 aa, Artificial Sequence
  Description of Artificial Sequence: Synthetic peptide
CASNSIAGVAAAGDYADYDGGYYYDMDVW

SEQ ID NO: 2917 - protein, 28 aa, Artificial Sequence
  Description of Artificial Sequence: Synthetic peptide
CAADSTIYASYYECGHGLSTGGYGYDSW

SEQ ID NO: 2918 - protein, 28 aa, Artificial Sequence
  Description of Artificial Sequence: Synthetic peptide
CAKHMSMQQVVSAGWERADLVGDAFDVW

SEQ ID NO: 2919 - protein, 12 aa, Artificial Sequence [sequence omitted]

SEQ ID NO: 2920 - protein, 13 aa, Artificial Sequence
  Description of Artificial Sequence: Synthetic peptide
CASYTDNNSPFVF

SEQ ID NO: 2921 - protein, 12 aa, Artificial Sequence
  Description of Artificial Sequence: Synthetic peptide
CKSLTSTRRRVF

SEQ ID NO: 2922 - protein, 12 aa, Artificial Sequence [sequence omitted]

SEQ ID NO: 2923 - protein, 12 aa, Artificial Sequence
  Description of Artificial Sequence: Synthetic peptide
CSSLTDRSHRIF

SEQ ID NO: 2924 - protein, 14 aa, Artificial Sequence
  Description of Artificial Sequence: Synthetic peptide
CGTWDVRPNRGAVF

SEQ ID NO: 2925 - protein, 14 aa, Artificial Sequence
  Description of Artificial Sequence: Synthetic peptide
CATWSASLSSARVF

SEQ ID NO: 2926 - protein, 13 aa, Artificial Sequence [sequence omitted]

SEQ ID NO: 2927 - protein, 11 aa, Artificial Sequence
  Description of Artificial Sequence: Synthetic peptide
CETWDGSGGVF

SEQ ID NO: 2928 - protein, 11 aa, Artificial Sequence [sequence omitted]

SEQ ID NO: 2929 - protein, 11 aa, Artificial Sequence
  Description of Artificial Sequence: Synthetic peptide
CQQYYSPLLTF

SEQ ID NO: 2930 - protein, 13 aa, Artificial Sequence
  Description of Artificial Sequence: Synthetic peptide
CQQYYSSPPSYTF

SEQ ID NO: 2931 - protein, 11 aa, Artificial Sequence [sequence omitted]

SEQ ID NO: 2932 - protein, 11 aa, Artificial Sequence [sequence omitted]

SEQ ID NO: 2933 - protein, 11 aa, Artificial Sequence [sequence omitted]

SEQ ID NO: 2934 - protein, 10 aa, Artificial Sequence [sequence omitted]

SEQ ID NO: 2935 - protein, 11 aa, Artificial Sequence [sequence omitted]

SEQ ID NO: 2936 - protein, 11 aa, Artificial Sequence [sequence omitted]

SEQ ID NO: 2937 - protein, 12 aa, Artificial Sequence [sequence omitted]

SEQ ID NO: 2938 - protein, 12 aa, Artificial Sequence [sequence omitted]

SEQ ID NO: 2939 - protein, 11 aa, Artificial Sequence [sequence omitted]

SEQ ID NO: 2940 - protein, 12 aa, Artificial Sequence [sequence omitted]

SEQ ID NO: 2941 - protein, 10 aa, Artificial Sequence
  Description of Artificial Sequence: Synthetic peptide
CMQALQAVGF

SEQ ID NO: 2942 - protein, 11 aa, Artificial Sequence
  Description of Artificial Sequence: Synthetic peptide
CMQGLHSPWTF

SEQ ID NO: 2943 - protein, 11 aa, Artificial Sequence
  Description of Artificial Sequence: Synthetic peptide
CLQALQPPPTF

SEQ ID NO: 2944 - protein, 7 aa, Artificial Sequence [sequence omitted]

SEQ ID NO: 2945 - protein, 11 aa, Artificial Sequence [sequence omitted]

SEQ ID NO: 2946 - protein, 11 aa, Artificial Sequence
  Description of Artificial Sequence: Synthetic peptide
CQQSYSTPRTF

SEQ ID NO: 2947 - protein, 11 aa, Artificial Sequence [sequence omitted]

SEQ ID NO: 2948 - protein, 11 aa, Artificial Sequence [sequence omitted]

What is claimed is:

1. A nucleic acid library comprising a plurality of nucleic acids, wherein each nucleic acid comprises:
   a) a nucleic acid sequence comprising a length of about 80 to about 230 base pairs that encodes for a CDR-H3 loop, wherein the CDR-H3 loop comprises a sequence of any one of SEQ ID NOs: 2420 to 2436; and
   b) a nucleic acid sequence encoding a variable domain of light chain (VL), wherein the nucleic acid sequence comprises at least about 90% sequence identity to any one of SEQ ID NOs: 94, 96, 98, 283, 301, 321, 416, 432, 459, 460, 616, 618, 647, 652, 660, 666, 677, 745, 755, 1627, 1883, and 2043, wherein each of the nucleic acids encodes for a sequence that when translated encodes for an immunoglobulin scaffold that comprises a GLP1R binding domain, and wherein the GLP1R binding domain is a ligand for GLP1R.

2. The nucleic acid library of claim 1, wherein the immunoglobulin scaffold further comprises one or more domains selected from variable domain of heavy chain (VH), constant domain of light chain (CL), and constant domain of heavy chain (CH).

3. The nucleic acid library of claim 2, wherein a length of the VH domain is about 280 to about 300 base pairs.

4. The nucleic acid library of claim 1, wherein a length of the VL domain is about 90 to about 120 amino acids.

5. The nucleic acid library of claim 1, wherein a length of the VL domain is about 300 to about 350 base pairs.

6. The nucleic acid library of claim 1, wherein the library comprises at least $10^5$ non-identical nucleic acids.

7. The nucleic acid library of claim 1, wherein the immunoglobulin scaffold comprises a single immunoglobulin domain.

8. The nucleic acid library of claim 1, wherein the immunoglobulin scaffold comprises a peptide of at most 100 amino acids.

9. The nucleic acid library of claim 1, wherein the nucleic acid sequence encoding a variable domain of light chain (VL) comprises a sequence having at least about 90% sequence identity to SEQ ID NOs: 94, 96, and 98.

10. The nucleic acid library of claim 1, wherein the nucleic acid sequence encoding a variable domain of light chain (VL) comprises a sequence having at least about 90% sequence identity to any one of SEQ ID NOs: 616, 618, 647, 652, 660, 666, 677, 745, and 755.

* * * * *